United States Patent 11,723,967 (ZIKA VIRUS VACCINE) - sequence listing, part 8

SEQ ID NO: 9612 - RNA, 1582 nt, Artificial Sequence
  KU761561.1 solE mRNA Design 3 opt
gggagaaagcuuaccaugagccaaaaaguaauauaccucgucaugauccugcucauagcccccgcuuacuccauacgcugcaucggcgucagcaacagggacuucguagaaggcaugucaggcggcacauggguagacguaguccuagaacacgggggaugcgucaccguaauggcccaagacaaaccaacaguagacaucgaacucgucacgacgaccgucuccaacauggccgaaguacgcagcuacugcuacgaagcaagcauaucagacauggcauccgacucccgcugccccacccaaggcgaagccuaccucgacaaacaauccgacacccaauacguaugcaaacgaacccuaguagaccgaggcuggggaaacggcugcggacuauucggaaaaggcucacucguaacaugcgcaaaauucgccugcagcaagaaaaugaccggaaaauccauccaacccgaaaaccucgaauaccgcauaaugcucuccguccacggaagccaacacucgggcaugaucguaaacgacaccggccacgaaaccgacgaaaaccgcgcaaaaguagaaauaacacccaacagccccagagcagaagcaacccucggcggcuuuggaucccucggacuagacugcgaaccccgaaccggccucgacuucagcgaucuauacuaccucacaaugaacaacaaacacuggcuaguccacaaagaaugguuccacgacauaccucugcccuggcacgccggugcagacacaggcaccccgcacuggaacaacaaagaagcccuagucgaguucaaagacgcccacgccaaacgccaaacagucgucguccuaggcagccaagaaggcgcaguccacaccgcccuagcaggagcccuagaagcagaaauggacggagcaaaaggaagauuaucauccggccaccugaaaugucgccuaaaaauggacaaacuccgacucaaaggggucagcuacagccucugcacggccgcauucacauucacaaaaaucccagcagaaacacuccacggaaccgucacaguagaaguccaauacgcaggcaccgacggccccugcaaaguaccagcacaaauggccguagacaugcaaacccuaacccccgucggacgccuuaucaccgcaaacccaguaaucacggaaucaaccgaaaacagcaaaaugaugcuagaacucgacccgcccuucggcgacagcuacauaguuauaggcguaggagaaaagaaaauaacccaccacuggcaucgcagcgguucaaccaucggaaaagccuucgaggccaccguacgcggcgcacgccgcauggccguacucggcgacacggccugggacuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9613 - RNA, 1582 nt, Artificial Sequence
  KY075937.1 solE mRNA Design 3 opt
gggagaaagcuuaccaugagccaaaaaguaauauaccuagucaugauacuacucaucgcacccgccuacucaauccgcugcauaggcgucucaaaccgagacuucgucgaaggcaugagcggaggaacgugggucgacguaguacucgaacacggcggaugcgugaccguuauggcacaagacaaaccaaccgucgacauagaacucgucacaacaacggucucaaacauggccgaaguccgcucauacugcuacgaagcauccauaagcgacaugguaucugacucacgcugcccaacccagggagaagcguaccuagacaaacaaagcgacacccaauacgucugcaaaagaacccuaguggaccgcggauggggaaacggcugcggccuauucggcaaaggaagccuaguaacaugcgccaaauucgccugcagcaagaaaaugaccggcaaaucaauacagcccgaaaaccuagaauacagaauaaugcuaagcguccacggcucacaacacuccggaaugaucguaaacgacaccggacaugaaaccgacgaaaaccgagcaaaagucgaaaucaccccaaacucacccagagccgaagccacccuaggaggauucggcagccuaggccuagacugcgaaccacgaaccggacucgacuucuccgaccucuacuaccuaacaaugaacaacaaacacuggcucguccacaaagaaugguuccacgacaucccccuccccuggcacgcaggagcagacaccggcacaccccacuggaacaacaaagaagcgcucgucgaguucaaagacgcacacgccaaacgccaaaccgucgucguacuaggaagucaagaaggcgccguacacaccgcacucgcaggcgcacuagaagcagaaauggacggagccaaaggccgacucagcagcggacaccucaaaugccgacuaaaaauggacaagcuacgccucaaaggagucuccuacagccuaugcacagcagcguuuacauucacgaaaaucccagcagaaacccuccacggcacagucacggucgaaguacaauacgcaggcacagacggacccugcaaaguccccgcgcaaauggccguagacaugcaaacccugaccccaguaggccgccuuaucaccgccaacccagucaucaccgaauccacagaaaacuccaaaaugaugcucgaacuagaucccccguucggagacuccuacauaguaauaggcguaggagaaaagaaaaucacccaccacuggcacagaucgggcuccacaaucggcaaagcauucgaagcaaccguccgaggcgccaaacgcauggccguacucggagacacggcaugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9614 - RNA, 1582 nt, Artificial Sequence
  KY014317.1 solE mRNA Design 3 opt
gggagaaagcuuaccaugagccaaaaaguaauauaccucgucaugauccuucucaucgcaccagcauauuccauacgcugcauuggaguaucaaacagagacuucgucgaaggaaugagcggaggcacguggguggacgugguccuagaacacgggggcugcguaaccguaauggcucaagacaaaccgacaguagacaucgagcuagucaccaccaccgucucaaacauggcagaagucagaaguuacugcuacgaagccagcauaagcgacauggcaagcgacagcagaugccccacccaaggcgaggcauaccucgacaaacaaagcgacacccaauacguaugcaaacgcacacucguagaccgcggcuggggcaacggcugcggacuauucggcaaaggaagccucgucacaugcgccaaauucgcaugcucaaagaaaaugaccggcaaaagcauacagcccgagaaccuggaauaccgaauaaugcucagcguacacggaucacaacacucaggcaugaucgugaacgacacagggcaugaaaccgacgaaaaccgcgccaaaguagaaaucaccccgaacuccccaagagccgaagccacacucggcggcuucggcucacuaggacucgacugcgagccaagaaccggccuagacuucucagaccuuuacuaccucacaaugaauaacaaacacuggcucguccacaaagaaugguuccacgacauaccccuccccuggcacgcaggcgcagauacaggaacgccccacuggaacaacaaggaagcacuuguagaguucaaagacgcacacgccaaacgacaaaccguagucguacucggaagccaagaaggagccgugcacaccgcccuagcaggagcccucgaagccgaaauggacggagccaaaggcagacuaucaagcggacaccuaaaaugccgccuaaaaauggacaaacuacgacucaagggcguauccuacagccuaugcaccgcugcauuuaccuuuacaaaaauacccgccgaaacacuacacggcacaguaacagucgaaguccaguacgcaggcacagacgggcccugcaaaguaccagcacaaauggcaguagacaugcaaacgcuaacgcccguaggacgccucaucacagccaacccagucaucaccgaaagcauagaaaacagcaaaaugaugcuagaacuagaucccccauucggagacucauacauagucaucggcguaggagaaaagaaaaucacgcaccacuggcaccgcucaggaucaaccaucggcaaagccuuugaagcaacagugcgaggcgccaaacgcauggccguacucggagacacagccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9615 - RNA, 1582 nt, Artificial Sequence
  KU870645.1 solE mRNA Design 3 opt
gggagaaagcuuaccaugucgcaaaaaguaauauaccuagucaugauacugcucauagcaccagccuacaguauacgaugcaucggcgucagcaacagggacuucgucgaaggcaugagcggaggcacauggguugacgugguacuagaacacggcggaugcguaaccgugauggcacaagauaaaccaacgguagacaucgaacugguaacaacaacaguaagcaacauggccgaaguaaggagcuacugcuacgaagcaagcauaagcgacauggcaagcgacuccagaugcccaacacaaggcgaagccuaccucgacaaacaaagcgacacccaauacgucugcaaacgcacacucguagauagaggcuggggaaauggcugcggccuauucggaaaaggaagccucgucacgugcgcaaaauucgccugcagcaagaaaaugaccggcaaaucgauccaaccagaaaacuuagaauaucgaaucaugcugagcguacacgggagccaacacuccggaaugauagugaacgacacaggacacgaaaccgacgagaacagggcaaaaguagaaaucacaccaaacucaccccgggccgaagccacacucggaggauucggaagccucggacuagacugcgaaccaagaacaggacucgacuucagugaccuauacuaccucacaaugaacaacaaacacuggcucguacacaaagaaugguuccacgacaucccacugccauggcacgcgggcgcagacacaggcacaccccacuggaacaacaaagaagcccuaguagaguucaaagacgcacacgccaaacgccaaaccguagucguacuaggaagccaagaaggggccguacacacagcccuggccggggcacucgaagcagaaauggacggagcaaaaggcaggcucucgucaggacaucuaaaaugccgccuaaaaauggacaaacucaggcucaaaggcgugagcuacagccuguguacagcagcauucacauucacaaaaauacccgcagaaacacuccacggcacagucacgguagaaguacaauacgcaggcacagacggcccaugcaaaguacccgcgcagauggccgucgacaugcaaacacuaacacccguaggacgacuaauaaccgcaaacccggucauaaccgaaagcacggaaaauagcaaaaugaugcucgaacuagacccaccauucggcgauucauacaucgucaucggcauaggcgaaaagaaaaucacacaccacuggcaccgcucaggcucaacaauaggcaaagccuuugaagcaaccguacgcggggcaaaacgcauggcagugcuaggggacacagcaugggacuucggcagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9616 - RNA, 1582 nt, Artificial Sequence
  KU922923.1 solE mRNA Design 3 opt
gggagaaagcuuaccaugucacagaaagucaucuaccuagucaugauccuccuaaucgcacucgccuacucaauacgcugcauaggagucuccaaccgagacuucguagaaggaauguccggcggaaccuggguagacguaguccucgaacacgggggcugcguaacagucauggcccaagacaaacccaccgucgacauagaacucguaaccaccaccgucucaaacauggccgaaguccgaucguacugcuacgaagccagcaucuccgacauggccuccgacucccgaugcccaacccagggagaagccuaccuagacaaacaaagcgacacacaauacguaugcaaacgaacacucgucgaccgcggcuggggaaacgguugcggacuauucggcaaaggaagccuagucacaugcgcaaaauucgcaugcucaaagaaaaugaccggcaaauccauccaaccagaaaaccucgaauaccgaauaaugcucagcguccacggcucacaacacagcggaaugauaguaaacgacaccggacacgaaaccgacgaaaaccgcgcaaaagucgaaaucacccccaacuccccacgcgccgaagccacccuaggaggauucggaucccucggacuagacugcgaacccagaaccggccucgacuucuccgaccucuacuaccucaccaugaacaacaaacacugguuaguccacaaagaaugguuccacgacaucccccuccccuggcacgccggcgccgacacaggaaccccgcacuggaacaacaaagaagcccucgucgaguucaaagacgcgcacgccaaacgacaaaccgucgucguacuagggucccaagaaggagccguacacacagcacuagccggcgcccuugaagcagaaauggacggcgcuaaaggccgacucagcuccggacaccucaaaugcagacuuaaaauggacaaacuccgccucaaaggcgucagcuacagccucugcaccgccgcauucacauucacaaaaauacccgccgaaacccuccacggcaccgucacaguagaaguccaauacgccggaaccgacggccccugcaaaguaccagcccaaauggcagucgacaugcaaacacuaaccccagucggacgacuuaucacggcaaaccccgucaucacagaaucaaccgaaaacuccaaaaugaugcucgaacucgacccaccuuucggcgacuccuacaucguaaucggaguaggcgaaaagaaaaucacacaccacuggcaccgauccggauccacgaucggcaaagccuucgaagcaacaguccgcggagcaaaaagaauggccguacucggagauaccgccugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9617 - RNA, 1582 nt, Artificial Sequence
  KU497555.1 solE mRNA Design 3 opt
gggagaaagcuuaccaugagccaaaaagucauauaccuagucaugauccuccucauagccccagcauacuccauacgcugcaucggaguaagcaaccgagacuucgucgaaggaaugucaggcggaaccugggucgacgucguacuagaacacggcggaugcguaacaguaauggcccaagacaaaccaacaguagacaucgaacucguaacaaccacagucagcaacauggcagaaguaagauccuacugcuacgaagccucaauaagcgacauggcauccgacuccaggugcccaacacaaggcgaagccuaccucgacaaacaaagcgacacacaauacgucugcaaaagaacacuuguagacagaggauggggcaacggaugcggccucuucggaaaaggaagccucguaaccugcgccaaauucgccugcagcaaaaagaugacaggaaaaucgauccaacccgaaaaccuagaauaccgcaucaugcucuccguccacggcagccagcacucaggcaugauagucaacgacacaggacacgaaacagacgaaaaccgagccaagguagaaauaaccccaaacagcccccgagccgaagcaacccucggaggauucggaucacuaggacuagacugcgaaccccgaaccggccucgacuucuccgaccuauacuaccuaaccaugaacaacaaacacuggcucguccauaaggaaugguuccacgacauaccccugcccuggcacgcgggcgcagacacgggcacaccccacuggaacaacaaagaagcccucgucgaguucaaagacgcccacgcaaaacgccagaccguagucguacuaggcacccaagaaggagccguccacaccgcccuggccggagcccucgaagccgaaauggacggagcaaaagggcgacucagcagcggccaccuaaaaugccgccuaaaaauggacaaacuaagacuaaaaggcguaucauacagccuaugcacagcagcauucaccuucaccaaaaucccugcagaaacacuccacggcaccgucacggucgaaguccaguacgccggcacagacggacccugcaaagucccagcccaaauggccgucgacaugcaaacccuaacacccgucggaagacuaauaaccgccaaccccguaaucaccgaaagcacagaaaauucaaaaaugaugcucgaacuagaucccccguucggagacuccuacauaguuaucggcguaggcgagaaaaagaucacacaccacuggcacagauccggcagcacaauaggaaaggccuucgaagcaacaguccgcggagcaaaacgaauggcaguccucggagacacagccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9618 - RNA, 1582 nt, Artificial Sequence
  KU312314.1 solE mRNA Design 3 opt
gggagaaagcuuaccaugucgcaaaaagucaucuaccuagucaugauccuccuaauagccccggccuacaguauacgaugcaucggcgucagcaacagggacuucgucgaaggcaugagcgggggcacguggguagacguaguuuuagaacacggcggaugcguaaccgugauggcacaagacaagccaaccguagacauagagcuagucacaaccacaguuucaaacauggcagaagucaggagcuacugcuacgaagcgagcauaagcgacauggcgagcgacagcagaugcccaacucaaggcgaagccuaccuugacaaacaaagcgacacccaguacguaugcaaaagaacccuagucgaccgaggaugggggaacgguugcggacuauucggaaaagggagccuagucacaugcgcgaaauucgccugcagcaaaaagaugacaggaaaaagcauccaacccgagaaccuagaauaucgaauaaugcucagcguacacgggagccaacacucaggaaugauagucaacgacacagggcacgaaaccgacgaaaaccgagcgaaaguggagauaacuccaaacucacccagagcugaggcaacacuaggaggcuucgggucacuuggacuagacugcgaacccagaacaggccucgacuucucggaccuauacuaccuaacaaugaacaacaaacacuggcucgugcacaaagaaugguuccacgacauaccacuaccuuggcacgcaggagcagacacagguacaccacacuggaacaacaaggaagcacucguagaguucaaagacgcacaugccaaacgacagaccguagucguacucgggagccaagaaggggccguacacacggcccuggcaggagcacuagaagcagaaauggacggagccaagggccgacucagcagcggccaccucaagugcagauugaaaauggacaagcuacgacucaaaggcguaagcuacagucuaugcaccgccgcauucacauucacaaaaaucccagcagaaacgcuacacggcacagucaccgucgaaguucaguacgccggaacagacggaccaugcaaagugcucgcccagauggcagucgacaugcaaacgcuaacgcccguagguaggcucauaaccgcgaacccgguaaucacagaaagcacagaaaacagcaaaaugaugcucgagcucgacccacccuucggagacagcuacaucgucauaggggugggagaaaagaaaaucacacaccacuggcaccgcagcgguucaaccaucggcaaagccuucgaagcgaccguacgaggagcuaaaagaauggccguacucggagacacagccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9619 - RNA, 1582 nt, Artificial Sequence
  KY014314.1 solE mRNA Design 3 opt
gggagaaagcuuaccaugagccagaaagucaucuaccuagucaugauccugcucauagcaccagcauacagcauaagauguaucggagucuccaacagagacuucgucgaaggaaugagcggaggaaccuggguagacguagucuuagaacacgguggcugcgucaccgugauggcacaagacaaaccgacaguagacauagaacucgucacaacaacaguaagcaacauggcagaaguacgaagcuacugcuacgaagcguccauaagcgacauggccagcgacagcagaugcccaacacaaggcgaagcauaccuagacaaacaauccgacacacaguacgucugcaaacgcacccuaguagacagaggguggggcaacggaugcggacuauucgggaaagggagccuagucacaugcgccaaauucgccugcucaaagaaaaugacaggaaaaagcauacaaccagaaaaccuagaauaccgaauaaugcuaagcguacacggaagccaacacagcggcaugaucguaaacgacaccggacacgaaacagacgaaaaccgagcaaaagucgaaauaacacccaacagcccccgagccgaggccacacuaggcgguuucggaagccucggacucgacugcgaaccacgcacagggcuagacuucuccgaccucuauuaccuaacaaugaacaacaaacacuggcucguccacaaagaaugguuccacgacauaccccuacccuggcacgcaggcgcggacacaggaaccccgcacuggaacaacaaagaagcccuagucgaguucaaagaagcccacgccaaacgacagacaguagucguccuaggaagccaagaaggagccguccacacagcccuagcaggagcacucgaagcagaaauggacggggccaaaggacgccuaagcuccggacaucuaaaaugccgccuaaaaauggacaaacucagacuaaaaggagucagcuacagccuaugcacagccgccuucaccuucaccaaaauaccggcagaaacacuccacggcacagucaccgucgaaguccaauacgcaggcaccgacggaccaugcaaaguacccgcacaaauggccguagacaugcaaacacuaaccccagugggacgacucauaacugccaacccagucaucaccgaaucaaccgaaaacagcaaaaugaugcuagagcucgacccaccauucggagacagcuacauagucaucggcgucggcgagaagaaaauuacgcaucacuggcacagaagcggcucgaccauaggcaaagccuucgaagcaacaguacgcggagcaaaacgaauggccguccucggagacacagccugggacuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9620 - RNA, 1582 nt, Artificial Sequence
  KX447517.1 solE mRNA Design 3 opt
gggagaaagcuuaccaugucgcaaaaagucaucuaccuaguaaugauccugcuaauagcaccagccuacaguaucagaugcauaggagucucgaacagggacuucguagagggaaugucagggggcacguggguagacgugguacuagaacacggcggaugcgugaccgugauggcgcaagacaaaccgaccguagacauagaacucgucacgacaacggucucaaacauggccgaggucaggagcuacugcuacgaagcgaguauaagcgacauggcaagcgacagcagaugcccgacacagggcgaggccuaccucgacaaacagagcgacacccaauacgugugcaaacgcacccuaguggaccgaggcuggggcaacggcuguggccuguucgggaaggggagccucgucacaugcgcaaaauucgccugcagcaagaaaaugacaggaaaaagcauccagcccgaaaaccuggaauacagaauaauguuaagcgugcacggaagccagcacucaggcaugaucguaaacgacacaggccacgagaccgacgaaaaccgcgcaaaaguggaaauaaccccgaacucgccgagggcagaagccgcccuagggggauucggcucgcuagggcuagacugcgagccaagaacaggccuggacuucagcgaccuauacuaccuaacgaugaacaacaaacacuggcuagugcacaaggagugguuccacgacauacccuugcccuggcacgcgggagccgacacaggaacgccucacuggaauaacaaggaagcccuagucgaguucaaagacgcacacgcaaaacgacagaccguaguagugcuagggagccaggaaggggcagugcacacggcucuggccggagcacuggaagcggaaauggacggggccaaaggcaggcucucauccgggcaccugaaaugccgccugaagauggacaaacuaagacucaaaggcgucagcuauagccuaugcacggccgcguucacguucacgaaaauaccagccgaaacgcuacacggaacggucacgguagaaguccaguacgcgggcacggacgggccaugcaaagugccggcgcaaauggccguagacaugcaaacgcucacgccagugggaaggcuaauaaccgcgaacccaguaauaacagaaagcacagaaaauagcaagaugaugcucgagcucgaucccccguucggggacucauacauagucauaggcgugggcgagaaaaagauaacgcaccacuggcacagaucgggaucgaccauaggcaaagccuuugaagcgaccguacgcggggcaaaacgcauggcaguacucggggacacggcaugggacuuugguucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9621 - RNA, 1582 nt, Artificial Sequence
  KU729217.2 solE mRNA Design 3 opt
gggagaaagcuuaccaugucccagaaagucauauaccucguaaugauccuacuaaucgcaccagcauacagcauaagaugcauaggcguuuccaaccgagacuucguagaaggcaugagcggcggcacauggguagacgucguccucgaacacggaggaugcguaaccgucauggcccaagacaaacccacagucgacaucgaacuggucucuacaacagucuccaacauggccgaaguccgaagcuacugcuacgaagcaaccauaucggacaucgcauccgacagccgcugcccgacacaaggcgaagccuaccucgacaagcaaagcgacacacaauacgucugcaaacgaacgcucgucgaccgaggcugggguaacggcugcggccucuucggcaaagggucccucguaacaugcgccaaauucgccugcucaaagaaaaugacaggcaaauccauccaaccagaaaaccucgaauacagaaucaugcuauccguacacggcagccaacacuccggcaugauuguaaacgacacaggccacgaaaccgacgaaaaccgagcaaaaguagaaaucaccccaaacagcccccgagcagaagccacccucggcggauucggaagccucggccucgacugcgaacccagaaccggacucgacuucagcgaccucuacuaccucaccaugaauaacaaacacuggcucguacacaaagaaugguuccacgacaucccccuacccuggcacgcaggcgccgacaccggaacaccccacuggaacaacaaagaagcacucgucgaguucaaagacgcccacgccaaacgccagaccgcagucguccucggaucacaggaaggcgccguccauacagcccuagccggcgcccuagaagcagaaauggacggcgcgaaaggccgccucagcagcggccaccuaaaaugccgccucaaaauggacaaacuacgccuuaaaggcgucagcuauagccucugcacagcugcauucaccuucacaaaaauccccgcagaaacccuacacggcacagucaccgucgaaguacaauacgccggcacagauggcccaugcaaagugcccgcccaaauggccguggacaugcaaacccucaccccagucggcagacucauaaccgccaacccaguaaucaccgaaucaaccgaaaacuccaaaaugaugcucgaacucgaucccccauuuggagacuccuacauagucaucggcguaggcgaaaagaaaaucacccaccacuggcaccgcagcggauccaccauaggcaaagccuucgaagccacaguccgaggagcaaaaagaauggccgugcucggagacacagcaugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9622 - RNA, 1582 nt, Artificial Sequence
  KY328290.1 solE mRNA Design 3 opt
gggagaaagcuuaccaugucacaaaaagucauauaccuagucaugauccuacuaauagcaccagcguauagcauacgcugcaucggaguaagcaacagggacuucgucgagggcaugagcggaggcacauggguggacgucguacuggaacacggaggaugcguaacagugauggcacaagacaaaccaaccguagacauagagcuaguaacaacaacagucucgaacauggccgaagucagaucauacugcuacgaagccagcauaagcgacauggcauccgacuccaggugcccaacccagggcgaagcauaccucgacaaacaaagcgacacacaguacguaugcaaaagaacccuaguggacagaggauggggcaacggaugcggacuauucggaaaagggagccucgucacaugcgcaaaauucgccugcagcaagaaaaugacagggaaaucaauacagccagaaaaccuagaauaccgaauaaugcucagcgugcacggaagccaacacucaggcaugaucguaaacgacaccgggcacgaaacagacgaaaaccgcgcaaaagucgaaauaacaccaaacucacccagagccgaggccacacuugggggauucggcagccucgguuuagacugcgaaccaaggaccgggcucgacuucucagaccuguacuaccucacaaugaauaacaaacacuggcucguacacaaagaaugguuccaugacaucccccuacccuggcacgccggcgcagacacaggcacgccacacuggaacaacaaagaagcgcucguggaguucaaagacgcccacgccaaacgccaaaccguaguggugcuagggagccaggaaggagcagugcacacagccuuagccggcgcccuggaagcagaaauggacggagcaaaaggccggcucagcagcggacaccucaaaugccgacugaaaauggacaaacuacgccuaaaaggagugagcuacagccucugcacagccgcguucacauucagcaagauacccgcggaaacacuacacggaacaguaacagaagaaguccaauacgcaggcaccgacggacccugcaaggugcccgcacaaauggccguagacaugcaaacacucacaccgguuggcagacucaucaccgcaaaccccgugauaaccgaaagcacagaaaacucaaaaaugaugcucgaacucgacccgccauucggagacucguacauaguaauaggaguaggcgaaaagaaaaucacgcaccacuggcaccgcagcggaucaacaaucggcaaagccuucgaagcgaccgucagaggagcaaaacgcauggcgguacugggagacacagcaugggacuucggaucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9623 - RNA, 1582 nt, Artificial Sequence
  KX087101.3 solE mRNA Design 3 opt
gggagaaagcuuaccaugucccaaaaaguaauauaccuaguaaugauccuccuaauagcacccgcauacagcauccgcugcauaggggucucgaacagggacuucguagaaggcaugagcggaggaacauggguagacguagucuuagaacacggcggcugcgucaccguaauggcccaagacaaaccaaccguagacauagaacuggucaccaccacgguaucgaacauggcagaaguccgaagcuacugcuacgaagccagcaucagcgacauggccucagacagccgaugccccacccaaggcgaagccuaccucgacaaacaaucagacacccaauacguaugcaaacgcacccuaguagaccgaggcuggggcaacggcugcggccuguucggaaaagggagccuggucacaugcgccaaauucgccugcuccaagaaaaugacaggaaaaucaauccaacccgaaaaccuagaauaucgcaucaugcuauccguacacggaucccaacacuccggaaugauaguaaacgacacaggacacgaaaccgacgaaaaccgcgccaaaguagaaauaaccccaaacucucccagagccgaagccacacucggaggauucggcucccuaggccuagacugcgaaccccggaccgggcucgacuucuccgaccucuacuaccucaccaugaacaacaaacacuggcucguccauaaagaaugguuucacgacauaccccucccauggcacgcaggcgcagacaccgguacaccacacuggaacaacaaggaagcgcuaguagaguucaaagacgcccacgccaaacgccaaaccguagucgugcuaggcagccaggaaggagccguacacacagcacuggccggagcucucgaagcagaaauggacggagccaaaggccggcuaucaagcggacaccuaaaaugccgccuaaaaauggacaagcuaagacucaaaggcgugagcuacagccuaugcacagccgcauucacguucaccaaaauaccugcagaaacccuacacggaacaguaacagucgaacuccaauacgcaggcacggacggacccugcaaagugcccgcccaaauggccguggacaugcaaacgcucacacccguaggaaggcucauuacagcaaacccagucaucaccgaaagcacagaaaacucaaaaaugaugcuagaacuugaucccccauucggagacucguacauagucaucggcguaggggagaaaaagaucacacaccacuggcaccgaucaggcucaacaaucggcaaggccuucgaagccaccguccgaggagcaaaacgaauggccguacuaggggacacagccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9624 - RNA, 1582 nt, Artificial Sequence
  KY003156.1 solE mRNA Design 3 opt
gggagaaagcuuaccaugagccaaaaagucauauaccuggucaugauccuccuaauugcaccagccuacagcauacguugcaucggcaucuccaacagagacuuugucgaaggcaugagcggagggacguggguagacgugguacuagaacacggaggcuguguaaccguaauggcccaagacaaaccaaccgucgacaucgagcuagucacuacaacagucagcaacauggcagaaguccgaagcuacugcuacgaagccagcauaagcgauauggcgagcgacagcagaugcccaacccaaggugaagcauaccuagacaaacaaagcgacacccaguacgugugcaaacgcacacugguagaccggggcuggggcaacggcugcggccuguucggcaaaggaucccuagucacaugcgcaaaauucgccugcagcaagaaaaugaccggaaaaucuauccaaccagaaaaccuagaauaucgcauaaugcuaagcguacacggaagccagcacuccggaaugaucguaaacgacaccggacacgaaaccgacgaaaaccgagccaaaguagaaaucacccccaacucgcccagagcagaagcaacccuuggaggcuucggaauccuaggacucgacugcgaacccaggaccggacuagacuucagugaccuguacuaccuaacaaugaacaacaaacacuggcucguccacaaggaaugguuccacgacauaccccucccuuggcacgcaggcgcagacacaggaacgccacacuggaacaacaaggaagcacucgucgaguucaaagacgcccacgccaaacgucaaaccgucguaguccucggcucacaagaaggagccguacacacagcccuggcaggagcccucgaagcagaaauggacggagcaaaaggacgccuaagcagcgggcaccuaaaaugccgccuaaaaauggacaaacuccgacucaaaggcguaagcuacagccuaugcaccgccgcauucaccuucacaaaaauacccgcagaaacccuccacggcaccgucaccgucgaaguccaauacgcaggaaccgacggaccaugcaaaguccccgcacaaauggcaguagacaugcaaacccucacaccaguaggaagacucaucaccgcaaacccagucaucaccgagagcaccgagaacucaaaaaugaugcucgaacucgacccacccuucggcgacucuuauauagucaucgggguaggagaaaagaaaaucacacaccacuggcaccgaucgggcuccaccauaggaaaagccuucgaagcaaccguccgcggagccaaacgcauggcugugcucggagacacggcuugggacuucggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9625 - RNA, 1582 nt, Artificial Sequence
  KU758876.1 solE mRNA Design 3 opt
gggagaaagcuuaccaugagccaaaaaguaauauaccucgucaugauacuacuaauagccccggcauacaguaucagaugcaucggggucagcaacagagacuucgucgaaggcaugaguggaggcacguggguagacguaguacuagaacacggaggaugcgucacagucauggcacaagacaaaccgaccguagacauagagcuaguaacaaccaccgucagcaacauggccgaagucagaagcuacugcuacgaagccaguauauccgacauggccagcgacucgaggugccccacccaaggcgaagccuaccuugacaaacaaagcgacacacaauacguaugcaaaagaacccuagucgaccgaggcuggggaaacggaugcggccucuucggaaagggaagccuagucacaugcgccaaauuugcaugcagcaagaaaaugacaggaaaaagcauacaacccgaaaaccuagaauaccgcaucaugcuaagcguccacggaagccagcauagcggcaugauaguaaacgacacagggcacgaaaccgacgaaaaccgagccaaaguagaaaucacaccaaacagccccagagccgaagccacgcucggaggcuucggaagccuaggacucgacugcgaacccagaaccggacucgacuucagugaccucuacuaccuaacaaugaauaacaaacacuggcugguccacaaagaaugguuccacgacaucccacuacccuggcacgcaggagcggacacgggcacaccacacuggaacaacaaagaagcucucguagaauuuaaagacgcccacgcaaaacgccagaccguagucguccuaggaagccaagaaggagccguacacaccgcccuggcaggagcgcuggaagcggaaauggacggaguaaaaggaaggcuaagcagcggccaccucaaaugccgccuaaaaauggacaaacuacgccuaaagggcguaagcuacagccuaugcacagccgcguucacauucacaaagauaccagccgaaacgcuccacgggacagucacaguagaaguccaauacgcaggaacagacggaccaugcaaagugccagcacaaauggccgucgacaugcaaacccuaacccccguaggccggcuaauaacagcaaacccugucauaaccgaaucgacagaaaacuccaagaugaugcuagaacucgaucccccauucggcgacaguuacauugucauaggagugggcgaaaagaaaauaacacaccacuggcaucgaagcggaucaaccaucggcaaagccuucgaagccaccguacgaggagccaaacgcauggcagugcuaggcgacacagcaugggacuucggcaguugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9626 - RNA, 1582 nt, Artificial Sequence
  KU926310.1 solE mRNA Design 3 opt
gggagaaagcuuaccaugagccaaaaaguaauauaccuagucaugauccuacucauagccccagcauacagcauacgcugcauaggaguguccaaccgagacuucgucgaaggcaugucaggcggcacguggguagacguaguacuagaacacggcgggugcguaacagugauggcccaagacaaacccacagucgacaucgagcucgucacaaccacagucuccaacauggccgaagucagaucauauugcuacgaagcaagcaucuccgacauggcaagcgacagcagaugcccaacccaaggagaagccuaccuugacaaacaaucagacacccaauacgucugcaaacgcacccuagucgaccggggauggggcaacggaugcgggcuauucggaaaaggaucccuaguuacaugugccaaauucgcaugcucaaagaaaaugaccgggaaaucaauacaacccgaaaaccuagaauaccgcaucaugcugagcguacacggcagccaacauucaggcaugaucguaaacgacaccggacacgaaacagaugaaaaccgcgccaaaguggaaauaacuccaaacucccccagagccgaagccacacucggaggcuucggcucgcucggacucgacugcgaacccagaacaggccuugacuucucagaccuauauuaccuuacaaugaacaacaaacacuggcucguacacaaagaaugguuccacgauauaccccuacccuggcacgcaggcgcagacaccggcacaccccacuggaacaacaaagaagcccuaguagaguucaaagacgcacacgcaaaacgccaaaccgucguaguccucggaucacaagaaggcgccguacacacggcccuugccggcgcacuagaagcagagauggacggcgccaaaggccgacuaucaagcgggcaccugaaaugcagacucaaaauggacaaacuccgacuaaagggcguguccuacucacuaugcacagcagcauucacauucacaaagauacccgcagaaacccuacacggaacgguaacagucgaaguacaauacgccggcgcagauggaccaugcaaaguacccgcgcaaauggccguagacaugcaaacacucacgcccgucggacgacucauaacugcgaaccccgucauaacagaaagcacagaaaacuccaaaaugaugcuagaacucgaucccccauucggcgacuccuauauagucaucggcgucggagagaagaaaauaacacaccacuggcaccgcuccggcuccacuaucggcaaagccuucgaagccaccguacgaggagccaaacgaauggccguccucggagacaccgcaugggacuuuggaucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9627 - RNA, 1582 nt, Artificial Sequence
  KU681081.3 solE mRNA Design 3 opt
gggagaaagcuuaccaugucccagaaagucaucuaccugguaaugauccuacuaauagcccccgcauacagcauaagaugcaucggaguauccaacagagacuucgucgaaggaauguccggcggcacauggguagacguagucuuggaacacggaggcugcguaaccgucauggcacaagacaaacccaccgucgacaucgaacucgucacgaccacagucucgaauauggccgaagucagaagcuacugcuacgaagcaagcauaagcgacauggccagcgacagcagaugcccaacccaaggcgaagccuacuuagacaaacaguccgacacccaauacguaugcaaacgcacccucguagaccgaggcuggggaaacggcugcggccuguucggaaaaggaagccucguaaccugcgcgaaauucgccugcuccaagaaaaugaccggaaaaucaauccagccugaaaaccucgaauaccgcauaaugcucagcguccacggaagccagcauagcggcaugaucguaaaugacacaggacacgaaaccgacgaaaaccgcgcaaaaguagaaauaacaccgaacucccccagggccgaggccacacucggcggcuucggcucgcucggccucgacugcgaaccaaggaccggacuagacuucagcgaccuauacuaccucacaaugaacaacaaacacuggcuaguacacaaagaaugguuccacgacauaccccucccauggcacacaggcgccgacaccggcacaccccacuggaacaacaaagaagcccuaguagaguucaaagacgcccaugccaaacgccaaaccguggucguccucggaucacaggaaggcgccguucacaccgcucuagcaggagcccuagaagccgaaauggacggagccaagggacgacucucaagcggacaccucaaaugcagacucaaaauggacaagcuacgacuaaaaggaguaagcuauagccugugcaccgcagcauucaccuucaccaaaauacccgcagaaacacuccacggcacgguaaccgucgaaguacaauacgcaggcaccgacggcccaugcaaaguacccgcccaaauggccgucgacaugcaaacacuaacccccguaggccgacucauaacagcaaacccagucauaaccgaaggcaccgaaaauagcaagaugaugcucgaacuggacccgcccuucggcgacucguacauagucauaggagugggcgagaaaaagaucacacaccacuggcaccgcuccggcucaaccauaggcaaagccuucgaagccaccguccgaggggccaaacgcauggccgugcucggagacacagccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9628 - RNA, 1582 nt, Artificial Sequence
  KU744693.1 solE mRNA Design 3 opt
gggagaaagcuuaccaugucgcaaaaaguaauauaccucgucaugauccuccucauagcccccgccuacuccauacgcugcauaggcgucuccaaccgggacuucgucgaaggaaugagugggggcaccugggucgacguaguccuagaacacggcggaugcguaaccgcaauggcccaggacaagcccaccgucgacauagaacucguaacgacaacagucuccaacauggccgaagucagauccuacugcuacgaagcaagcaucucagacauggcaagcgacagccgaugcccaacccaaggcgaagccuaccuagacaaacaaagcgacacccaauacguaugcaaacgaacccuagucgaccgcggcuggggcaacgggugcggccuauuugggaagggaagccucgucacaugcgcaaaauuugcaugcagcaaaaagaugaccgggaaaagcauccaaccagaaaaucucgaauaccgcauaaugcuauccguccacggcagccaacacagcggcaugcuaguaaacgacaccggacacgaaaccgacgaaaaccgcgcaaaaguagaaauaacaccaaacuccccacgagcagaagcaacacucggcggcuucggaagccuaggccuagacugcgaacccagaaccggacucgacuucagcgaccucuacuaccucacaaugaacaacaaacacuggcuagcccacaaggaaugguuccacgacaucccacuacccuggcacgcaggcgcagcaacgggaacaccacacuggaacaacaaagaagcccuaguagaguucaaagacgcacaugcuaaacgacaaaccgucguaguacuaggaagccaagaaggcgcaguccacaccgcccucgccggagcacuagaagccgaaauggacggagccaaggggagacuuucaagcggccaccuaaaaugucgccuaaaaauggacaaacuacgccucaaaggcgucagcuacagccucugcacagccgcauucacauucaccaaaauaccugcugaaacagucgacggaacaguaacagucgaaggacaauacggaggaacugacggccccugcaagguaccagcacaaauggccgucgacaugcagacgcuaacgccaguaggacgacucauaaccgccaacccagucauaaccgaauccacagaaaacagcaaaaugaugcucgaacuagacccacccuucggggacuccuacauagucauaggagucggcgaaaagaaaaucacccaccacuggcaccgcagcggcucaaccauaggcaaagcauucgaagcgacaguacgcggagcaaaacgcauggccguacuaggagacacagccugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9629 - RNA, 1582 nt, Artificial Sequence
  EU545988.1 solE mRNA Design 3 opt
gggagaaagcuuaccaugucccaaaaggugauauaccuagucaugauccuccuaauagccccagccuacagcauacggugcaucggagucuccaacagagacuucgucgaaggcaugagcggaggaacauggguagacguaguccuagaacacggcggaugcguaacagugauggcgcaagacaaaccagccguagacauagaacuggucacaacaacggucagcaacauggcagaagucagaagcuacugcuacgaagcaagcauaagcgacauggcgagcgacagcagaugcccaacccagggcgaagcauaucucgacaaacaaucagacacacaguacguaugcaagagaacgcucguagaccgaggcuggggcaacggaugcggccuguucggaaaggggagccucgucacgugcgcgaaauucgcgugcagcaagaaaaugaccgggaaaucaauacagccagagaaccuggaauaccgaauaaugcucagcguccacggcagccaacacagcggcaugaucgucaacgacacaggacaugaaaccgacgaaaaucgcgcaaaagucgaaaucacaccgaacucgcccagagccgaagccacacucgggggauucgguagccuaggacucgacugcgagcccaggacaggacucgacuucucggaccuguacuaccuaacaaugaacaacaaacacuggcucgugcacaaagaaugguuccacgacauaccccuacccuggcacgcaggcgcagacacaggcacaccccacuggaacaacaaagaagcccuaguggaguucaaagacgcacaugcaaaacgacaaaccguaguagugcuaggaagccaggaaggagccguacacacagcccuggccggagcauuggaagccgaaauggacggagcaaaaggcaggcucuccagcgggcaccugaaaugccgccugaaaauggacaaacuacgacucaaaggcguguccuacagucucugcaccgcagcguucacauucacaaaaauacccgcagaaacgcuccacggcacggucacggucgaaguccaauacgcuggaaccgacggacccugcaaaguaccagcgcaaauggccguggacaugcagacgcucacaccagugggacggcucauaacagcgaacccagucauaacagaaagcacagaaaacaguaaaaugaugcucgaacuagacccgcccuucggggacuccuacauaguaaucggcguaggcgaaaagaaaauaacgcaccacuggcaccgcuccggcaguaccauaggaaaagcauucgaagcgacaguacgaggagccaagcgcauggcgguacugggagacacagccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9630 - RNA, 1582 nt, Artificial Sequence
  KY007221.1 solE mRNA Design 3 opt
gggagaaagcuuaccaugagccaaaaagucaucuaccuuguaaugauccuccuaauagccccagcguacagcauccgcugcaucggcguaaacaacagggacuucguagaaggcauguccggaggcaccuggguagacgucguacucgaacacgguggaugcguaaccguaauggcccaagacaaaccaaccguagacaucgagcuagucacgaccacaguaagcaacauggcagaagucaggagcuacugcuacgaagcaagcaucagcgacauggcaagcgacagccgcugcccaacccaaggagaagcguaccucgacaaacaaagcgacacacaauacgucugcaaaagaacccucguggaccgaggcuggggcaacggcuguggccuauucggcaaagggagccuagucacaugcgccaaauucgcaugcagcaagaaaaugaccggaaaaagcauccaacccgaaaaccuagaauaccgaauaaugcugagcguccacggaagccaacacucaggcaugaucgucaacgacaccggccacgaaacagacgaaaacagagcaaaaguagaaaucaccccaaacagccccagagccgaagcaacacuaggcggcuucggaagccugggacuggacugcgagccccgaaccggacuagacuucucagaccuauacuaccucacaaugaauaacaaacacuggcuaguacacaaagaaugguuccacgacauaccacugccauggcacgccggcgcggacaccggaacaccccacuggaacaacaaagaagcacucguagaguucaaagacgcccacgccaaacgccaaaccgucguaguacuaggcagccaagaaggagccguacacacagcccuggccggagcacucgaagccgaaauggacggggccaaaggccgacucuccagcgggcaccucaaaugccgccucaaaauggacaaacuacgacucaaaggcguaagcuacagccucugcacagccgcauucacauucaccaaaauacccgccgaaacccuacacgguacagugacagucgaaguacaauacgcaggcacggacgggcccugcaaaguacccgcacagauggccguagacaugcaaacacuaacaccagucggcagacucaucacagccaaccccguuaucaccgaaagcacagaaaacagcaaaaugaugcucgaacuagacccaccauuuggcgacagcuacauagucauuggagucggagaaaagaaaaucacacaccacuggcacagauccggcagcacaaucggaaaagccuucgaagcaaccguccgaggcgcgaaacgaauggcaguacuaggagacacagcaugggacuucgguagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9631 - RNA, 1582 nt, Artificial Sequence
  KY003152.1 solE mRNA Design 3 opt
gggagaaagcuuaccaugucccaaaaaguaauauaccuaguaaugauauuacucauagcaccggccuacagcauccgcuguauagggguauccaacagagacuucgucgagggcaugagcggcggcacaugggucgacgucguacuagagcacggcggcugcguaacagucauggcacaagacaaaccaaccguggacaucgagcuagucaccaccacagucucaaacauggccgaagucagaagcuacugcuacgaagcgagcaucagcgacauggcaagcgacagcagaugcccaacccaaggcgaggcuuaccucgacaagcagagcgacacccaauacgugugcaaacgcacgcuaguagacagaggcuggggaaauggaugcggacuuuucggaaaaggaagccuaguuacgugcgcaaaauucgccugcagcaagaaaaugaccgggaaaucaauccaacccgaaaaccuagaauaccgaauaaugcuaagcguacacggcagccaacacucgggaaugauaguaaacgacacaggacacgagacagacgaaaacagagccaaaguagaaauaacaccgaacucacccagggccgaggcaacacucggaggcuucggcucgcuagggcucgacugcgagcccagaaccggccuagacuucuccgaccuauacuaccucacaaugaauaacaaacacuggcuaguacacaaggaaugguuccacgacauaccacugcccuggcacgcaggcgcagacacaggaacaccccacuggaacaacaaggaagcccuagucgaguucaaagacgcacacgcaaagcgacaaaccguagucguccuuggaagccaagaaggagccguacacacagcccucgcaggggcccuggaagcagaaauggacggagccaaaggcagacuauccagcggacaccugaagugccgacucaaaauggacaagcucaggcucaagggagucuccuacagccuaugcgcagccgccuucacauucacaaaaauacccgcggaaacgcuccacggcacaguaacggucgaaguccaguacgcaggcacagacggacccuguaaaguacccgcgcaaauggcagucgacaugcaaacacuaacaccagucggcaggcucauaaccgccaacccggucauaaccgagaguacagaaaacagcaaaaugaugcucgaacucgaucccccauucggagacagcuacauaguaauaggaguaggcgaaaagaaaaucacccaccacuggcacagaucaggcucaacaauaggcaaagcauucgaagcaaccguacgcggagcaaaacgaauggccguccuaggggacaccgccugggacuuugguucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9632 - RNA, 1582 nt, Artificial Sequence
  KX694533.2 solE mRNA Design 3 opt
gggagaaagcuuaccaugucacaaaaaguaaucuaccucguaaugauccuacuaaucgcacccgccuacagcauacgaugcaucggaguaucaaaccgcgacuucgucgaagguauguccggcggaacauggguagacgucgucuuagaacacggagggugcguaacagucauggcccaagacaaaccaacaguagacauagagcucguaacaaccaccguaagcaacauggcagaaguccgcagcuacugcuacgaggccagcauaucagacauggccuccgacucacgaugcccaacacaaggagaagcauaccuagacaaacaaagcgacacccaauacgucugcaaaagaacacuggucgacagaggauggggcaacggaugcggccuauucggaaaaggcagccuaguaaccugcgcaaaauucgccugcagcaagaaaaugaccggcaaauccauacaaccagaaaaucuagaauaccgaauaaugcuauccguccacggaagccaacacuccggcaugaucgucaacgacaucggccacgaaaccgacgaaaaccgagccaaagucgaaaucacccccaacucaccccgagcagaagccacacucggcggcuucggaucccucggacuagacugcgaacccagaacaggccucgacuucagcgaccucuacuaccuaacaaugaacaacaaacacuggcucguccacaaagaaugguuccacgacauaccacugcccuggcacgcaggcgccgacacaggcacgccccacuggaacaacaaagaggcacucguggaguucaaagacgcccacgccaaaagacaaacaguaguaguacucggcagccaagaaggagccguccacacagcccucgcaggagcccucgaagccgaaauggacggagccaaaggcagacucuccagcgggcaccugaaaugccgccucaaaauggacaaacuacgccucaaaggcgucagcuacagccucugcacagcagccuucaccuucaccaaaauccccgccgaaacacuccacggaaccguaacaguagaaguccaauacgccggcacagacggacccugcaaaguacccgcacaaauggccgucgacaugcagacccucacgcccguaggaagacucaucaccgcaaaccccgucauaaccgaaagcacagaaaacagcaagaugaugcuagaacucgacccacccuucggagacagcuacaucguaauaggagugggagacaagaaaaucacacaucacuggcaccgcagcggcucaacaauaggcaaagcauuugaagccacaguacgcggggccaaaagaauggccguccuaggggacaccgccugggacuucggauccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9633 - RNA, 1582 nt, Artificial Sequence
  KX601167.1 solE mRNA Design 3 opt
gggagaaagcuuaccaugagucaaaaagucauauaccucgucaugauccugcuaaucgcccccgccuacagcauacgcuguaucggagugagcaacagggacuucguagaaggaaugaguggaggcaccugggucgacguaguacuagaacacggaggaugcguaaccguaauggcacaagacaaaccaaccguagacaucgagcuagucacaaccacagucucaaacauggccgaagucagaagcuacugcuacgaagcaagcaucagcgacauggcaagcgacagccgaugcccaacacaaggagaagcauaccuagacaaacaaagcgacacccaauacgugugcaaacgcacccuagucgaccgaggauggggcaauggaugcggccucuucggaaaaggaucccuagucacaugcgcgaaauucgcaugcagcaagaaaaugacuggaaaaucaauccagccagaaaaccuagaauaccgaaucaugcucucgguacacggcagucaacacagcgguaugauagugaacgacaccggacacgaaaccgaugaaaacagagccaaagucgaaauaaccccaaacucccccagagccgaagccacacuaggaggcuucggaucgcuaggacuugacugcgaaccaagaaccggacuagacuucuccgaccuauacuaucuaacaaugaacaacaaacacuggcucgugcacaaagaaugguuccacgauauaccacugccauggcacgcaggagcggacacaggaacaccccacuggaacaacaaagaagcccuaguagaguucaaagacgcccacgccaaacgacaaaccgucgucguacuaggcagccaggaaggagccguacacacagcccucgcgggcgcccuagaagccgaaauggacggagcaaaaggcagacuaucgucaggccaccucaaaugccgccugaaaauggacaaacuaaggcucaaaggagugucauacagccucugcacagccgcguucacauucacaaaaauaccagcagaaacacuccacggaacaguaacaguagaaguccaauacgcaggaacagacggacccugcaaaguccccgcccaaauggccguagacaugcaaacccucacgccagucggcagacugauaaccgcaaacccaguaaucacagaaagcacagaaaacucaaaaaugaugcucgaacuagacccaccauucggcgacagcuauauaguaauaggcgucggagacaagaaaaucacacaccacugguaccgcucaggcuccaccaucggaaaagccuucgaagccaccguacgaggagcaaaacgcauggcagugcuaggggacacggccugggacuucggaagcugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9634 - RNA, 1582 nt, Artificial Sequence
  KY288905.1 solE mRNA Design 3 opt
gggagaaagcuuaccaugagccaaaaaguaauauaccuaguaaugauccuacuaauagcccccgcauacagcauccgcugcauagggguauccaacagggacuucgucgaaggcaugagcggaggcacaugggucgacgugguccuagagcacggaggcugcguaaccguaauggcacaagacaaaccaaccgucgacaucgaacuggucaccaccacaguuagcaacauggccgaagucagaagcuacugcuacgaagcaagcaucucagacauggcaagcgacucccggugccccacacaaggagaagcauaccuagacaaacagagcgacacccaauacguaugcaaacgcacacucgucgaccgaggcuggggcaacggcugcggacuauucggaaaaggaagccucgucacaugcgcaaaauucacaugcagcaaaaaaaugacaggaaagagcauccaaccagaaaaccuagaauaccgcauaaugcuaagcguacacgguagccaacacucaggcaugauagucaacgacaccggccacgaaaccgacgaaaaccgagccaaaguagaggucacccccaacagcccacgagccgaagcaacccuaggcggcuucggcagcuuaggccucgacugcgaaccccgcaccgggcuagacuucagcgaccuauacuaccuaaccaugaacaacaaacacuggcucgugcacaaagaaugguuccacgacauacccuuaccauggcacgccggcgcggacacaggcacaccccacuggaacaacaaagaagcccucgucgaauucaaagacgcucacgccaaacgccaaacaguaguaguacuaggcagccaggaaggcgcgguacacaccgcccuagccggagcccuagaagccgaaauggacggggccaaaggccgacucuucagcggacaccugaaaugccggcugaaaauggacaaacucagacuaaaaggcgucagcuacagccuaugcacagcagccuucacauuuacaaaaguacccgcagaaacacuccacggcaccgucacagucgaaguacaauacgcaggcacagacggcccaugcaaaguaccagcacaaauggccguagacaugcaaacacucacaccagugggcagacucaucaccgccaacccaguaauaaccgaaagcaccgaaaacuccaaaaugaugcuagaacucgacccaccauucggcgacuccuacauaguaauaggcgucggcgacaaaaaaaucacacaccacuggcaucgaagcggcuccacaaucggcaaagcauucgaagcaaccguaagaggagccaaacgaauggcuguacucggcgacaccgcaugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9635 - RNA, 1582 nt, Artificial Sequence
  KF268950.1 solE mRNA Design 3 opt
gggagaaagcuuaccaugucgcaaaaagucaucuaccuaguaaugauccuccucauagccccagcuuacagcaucagauguaucggaguauccaacagagacuucgucgaaggcaugagcgggggcacaugggucgacguaguccuagagcacggcgggugugucacuguaauggcgcaagacaaaccaacaguagacauagagcuaguaacaaccaccgucucaaacauggccgaaguccgaagcuacugcuaugaagccagcauaagcgacauggcaagcgacagcagaugcccgacacaaggcgaagccuaccuagacaaacaaagcgacacccaauacguaugcaaacgcacccuaguagaccggggauggggaaacggcugcggccuauucgggaaaggaagccuaguaacaugcgccaaauucacaugcagcaagaaaaugaccgggaaaucaauccaacccgaaaaccuagaauaccgcauaaugcugagcgugcacggaagccaacacucaggcaugauaguaaacgacaucggccacgaaacagacgaaaaccgagcgaaaguagaagugacaccgaacucacccagggcagaagccacgcucggaggcuucgguucguuaggacuagacugcgagcccagaacaggacucgacuuuucggaccuguacuaccuaaccaugaacaacaaacacuggcugguacacaaagaaugguuccacgacauaccccugccauggcacgcaggagcagacacuggcacaccccacuggaacaacaaagaagcacucguggaguucaaagacgcccacgccaaacgacaaaccgucgucgugcucggaagucaagaaggagcagugcacaccgcccucgccggagcacuagaagcggaaauggacggggccaaaggccgccucuucagcggacaccucaaaugcaggcugaaaauggacaaacuaagacucaagggaguaagcuacagccucugcaccgcugcauucaccuucacgaaaguacccgcggaaacgcuacacggaacaguuacggucgaaguccaguacgcaggcacggacgggcccugcaaagugcccgcacagauggccguugacaugcaaacacucaccccagucggcagacucauaacugcaaacccggucaucaccgaaaguacggaaaacagcaagaugaugcuagagcuagaucccccauucggggacuccuacauagucaucggcgugggcgacaagaaaaucacgcaccacuggcaccgaucgggcucgaccaucggcaaagccuuugaagcaaccgugcgaggagccaaacgcauggccguccucggcgacacagccugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9636 - RNA, 1582 nt, Artificial Sequence
  KF383116.1 solE mRNA Design 3 opt
gggagaaagcuuaccaugucccaaaaaguaauauaccucgucaugauacuccucauagcccccgcauacagcauacgcugcaucggggucuccaacagagacuucgucgaaggaaugagcggaggcacauggguggacguaguccuggaacacggaggaugcguaaccguaauggcccaagacaaaccaaccgucgacauagagcuaguuacaaccaccgucuccaacauggccgaaguccgcuccuacugcuacgaagccagcauaagcgacauggccagcgacagcagaugcccgacccaaggcgaagccuaccuagacaaacaaagugacacccaauacgucugcaaacgaacacucguagaucgcggcuggggcaacggcugcggucuguucggaaaaggaagccuaguaaccugcgccaaauucacaugcagcaagaaaaugaccggaaaaucaauccagcccgaaaaccucgaauaccgcauaaugcuauccguacacgguagccaacacuccggcaugaucgucaacgacaucggacacgagacagacgaaaaccgcgccaaaguagaaguaaccccaaacucccccagggccgaagcaacacucggaggcuucggaucccuaggacuagacugcgaacccagaaccggccucgauuucagcgaccuauacuaccucacgaugaacaacaaacacuggcucguacacaaagaaugguuccacgacauaccccuacccuggcacgccggcgcagacaccggcacaccccacuggaacaacaaagaagcacucguagaguucaaagacgcacacgcaaaacgccaaaccguaguaguccuaggcagccaagaaggcgccguacacaccgcccuggccggagcgcuagaagcagaaauggacggagccaaaggcagacuauucagcggccaccuaaaaugccgacuaaaaauggacaaacucagacucaaaggaguaagcuacagccuaugcaccgccguaugcaccgccgccaaaguccccgcagaaacacuacacggcacagucacaguagaaguccaauacgcaggcacggacggccccugcaaagugccagcccaaauggccguagacaugcaaacucugacaccagucggcagacucauaaccgccaacccaguaauaacagaaagcacggaaaacucaaaaaugaugcuugaacucgacccgcccuucggagacucauacauagucauaggaguaggcgacaagaaaaucacacaccacuggcaccggagcggcuccacuauaggcaaagcauucgaagcaaccguaagaggagccaaacgaauggccguacuaggggacacagcaugggacuucggcuccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9637 - RNA, 1564 nt, Artificial Sequence
  KU963574.2 solE mRNA Design 3 opt
gggagaaagcuuaccaugucgcaaaaagucauauaccuggucaugauccugcuuaucgcacccgcuuacuccauccgcugcaucggagucucgaacagggacuucgucgaaggcaugagcggaggcacauggguagacguaguccuagaacacggcggcugcgugaccgucauggcacaagacaaaccgacaguagacauagaacucgucacaaccacagucucgaacauggcagaaguuagaaguuacugcuacgaagccagcauaagcgacauggcaagcgacagcagaugcccaacccaaggggaagcauaccuggacaaacaaagcgacacccaauacgucugcaaacgcacgcuaguagacaggggauggggcaacggaugcggacuguucgggaaaggaagccuagucacaugcgcgaaguucacaugcagcaagaaaaugacaggaaaauccauacaacccgaaaaccuagaauaccgaauaaugcugagcgugcacggaagccaacacagcggcaugauaguaaacgacgaaaaccgcgcgaaaguagaaguaaccccaaacagcccaagggccgaggcaacgcuaggaggauucggaagccuagggcucgacugcgagcccagaaccggacucgacuucucggaccuauacuaccuaacgaugaacaacaaacacuggcuaguacacaaagaaugguuccacgacauaccgcuccccuggcacucgggagcagacaccgaaacgccacacuggaacaacaaagaagcgcuaguagaguucaaagacgcccacgccaagcgacagacaguagucguacucgggagccaggaaggagccguacacacagcccucgccggagcccucgaagcagagauggacggagccaaaggccgacuaucguccggccaccuaaaaugccgccugaaaauggacaaacucaggcuaaaaggcgugagcuacagccugugcaccgccgcauucacauucacaaaagugcccgcagaaacacuccauggaacagucacagucgaaguccaauacgcaggaagggacgggcccugcaaaguacccgcgcagauggcaguagacaugcaaacgcuaacccccgucggcagacucauaacagcgaacccggucauaaccgaaagcacagaaaacagcaaaaugaugcuagaauuagaucccccauucggggacucauacaucgucauaggcguaggcgacaagaaaauaacacaccacuggcacagaucaggcuccauaauaggcaaagccuucgaagcaacagugcgaggagccaaacgcauggcaguacuaggagacaccgccugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9638 - RNA, 1582 nt, Artificial Sequence
  KF383118.1 solE mRNA Design 3 opt
gggagaaagcuuaccaugucacaaaagguaauauaccuagucaugaucguacucauagucccggcauacagcauaagcuguaucggaguaucaaaccgagaccugguagagggcaugagcgggggcacauggguggacgugguacuggaacauggcggaugcguaaccgaaauggcgcaagacaaaccgaccguggacauagagcuaguaacaaugaccgucucgaacauggcagaagucagaagcuacugcuacgaagcaagccugagcgacauggcaagcgcaaguaggugcccgacccaaggagaaccaucacuagacaaacaaagcgacacccagagcguaugcaagagaacgcuaggggacagaggcuggggaaacggcugcggaaucuucggaaaaggaucccuagucacgugcuccaaauuuacaugcugcaagaaaaugccagggaaaagcauccagccagagaaccucgaauauagaauaaugcuacccgugcacggcagccagcacucaggaaugaucgugaacgacaucggacacgagaccgacgaaaaccgcgcaaaaguggaaguaaccccaaacucacccagagcagaagccacgcucggaggauucggaagccucgggcucgacugcgaaccccgaaccgggcucgacuucucagacuuauacuaccuaacaaugaacaacaagcacuggcucguacacaaagagugguuccacgacauaccccugccauggcacgcgggagcagacacaggcacgccgcauuggaacaacaaggaggcacucguagaguucaaagacgcgcacgcaaagcgacaaacagucguagugcucggaagccaagaaggggccguccacacagccuuagccggggcccucgaagcagaaauggacggggcaaagggccggcucuuuagcggccaccuaaaaugccgccuaaaaauggacaagcuaagacuaaagggcguaagcuacagccugugcacagccgcauucacauucacaaaaguacccgcagaaacgcuccacggcacagucacagucgagguccagagcgcgggaacggacggacccugcaaaguaccagcgcaaauggccguagacaugcaaacacucacccccgugggaaggcuaauaacagcaaacccgguaauaaccgaaagcacagaaaacagcaagaugaugcucgaguuagacccaccauucggggacucauacauaguuauaggcguaggcgacaagaaaaucacgcaccauuggcacagauccggaaguaccaucggcaaagccuucgaagcaaccgugcgcggggccaagagaauggcagugcucggagauaccgcaugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9639 - RNA, 1582 nt, Artificial Sequence
  KX520666.1 solE mRNA Design 3 opt
gggagaaagcuuaccaugcgacaaaaagucauuuaccuaguaaugauacuccuaauagccccagccuacagcauuagaugcaucgggguaucaaacagggacuucguagaaggaaugagcggcggaaccuggguagacgucguccucgaacacggcggcugcguaaccguaauggcacaagacaaaccgaccguagacauagaacucgucaccaccacagucucaaacauggcagaaguccggagcuacugcuacgaggcuucuauaagcgacauggcaagcgacagcagaugcccaacccaaggcgaagcauaccuagacaaacaaagcgacacccaguacguaugcaaaagaacccucguagaccgaggauggggcaacggcugcggccuguucggaaaaggaagccugguaacaugcgcaaaauuugccugcagcaaaaagaugacagggaaauccauccaacccgaaaaccuagaauacagaauaaugcucagcguacauggaagccaacauagcggcaugaucgucaacgacacaggacacgagacagacgaaaaccgcgcaaaaguagaaaucaccccaaacucacccagggccgaggcaacacucggcggauucggcagccucggccucgacugcgaacccagaaccggccucgacuucucagaccuguacuaucuaaccaugaacaacaaacacuggcucguccacaaagaaugguuccacgacaucccacugcccuggcacgccggcgccgacacaggaacaccacacuggaacaacaaagaagcccuagucgaguucaaagacgcacacgcaaaacgacaaacagucgucguccucggcagccaagaaggagcaguccacacggcccuggcaggagcccucgaagcagaaauggacggagccaaaggcaggcucucaucaggacaccuaaaaugccgccuuaaaauggacaaacuccgacugaaaggaguauccuacagccucugcacagccgcauucaccuucacaaaaauaccagcggaaacacugcacggcacagucaccgucgaaguccaguacgcaggcaccgacggccccugcaaaguaccagcacaaauggcgguggacaugcaaacccuaaccccaguaggccgacuaauaaccgcgaacccagucauaaccgagagcaccgaaaacaguaaaaugaugcucgagcucgacccaccauucggagacagcuacauaguaauaggcgucggugaaaagaaaaucacacaccacuggcaccgcucgggcucaaccaucggcaaagccuucgaagcaacuguacgcggagccaaacgcauggcaguacuaggagacacagcaugggacuucggcucaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9640 - RNA, 1582 nt, Artificial Sequence
  KF383120.1 solE mRNA Design 3 opt
gggagaaagcuuaccaugagccaaagagucaucuaccugguaaugauccuacuaauagccccagccuacagcauccgaugcaucggggucucgaacagagacuucgucgaaggcaugagcggaggcacauggguagacguagugcuggaacacggcggaugcguaaccguaauggcacaagacaaaccaaccguagacauagagcuagucacaacaacagucucaaacauggccgaagucaggaguuacugcuacgaagcaagcauaagcgacauggccagcgacagccgaugcccaacccaaggcgaagcauaccuagacaaacaaagcgacacccaauacgugugcaaacgcacgcuagucgacagaggauggggcaacgggugcggccucuucgggaaaggaagccuagucacgugcgcaaaauucacaugcagcaagaagaugaccggaaaaucaauccaacccgaaaaccuagaauaccgcauaaugcugagcguccacggaagccaacacucaggcaugaucgucaacgacaucggacacgagaccgacgaaaaccgagcgaaaguggaaguaaccccaaacucaccaagggccgaggccacccucggaggcuucggaucgcucgggcuagacugcgaacccagaaccggacucgacuucucagaccucuacuaccucacgaugaacaacaaacauuggcucgugcacaaagaaugguuccacgauaucccacugcccuggcacgcaggcgcggacacaggaacaccccacuggaacaauaaggaagcacuuguagaguucaaagacgcccacgccaaacgccagaccguagucguacuaggaagccaagaaggagccgugcacaccgcccuggcaggagcacuggaagcagaaauggacggagccaaaggccgacucuucagcggacacuugaaaugccgcauaaaaauggacaaacucaggcucaaaggcgugagcuacagccuaugcacugccgcauucacauucuccaagguaccagcagaaacacuccacggcaccgucacgguagaaguccaauacgcaggccgagacgggccaugcaaagugcccgcacaaauggccguagacaugcaaacgcucacacccguaggcaggcucauaacagcgaacccaaucauaacagaaaguacagaaaacagcagaaugaugcuagaacucgacccaccguucggggacuccuacauagucaucggcgugggcgacaagaaaauaacacaccacuggcauagaucgggcucaaccauaggcaaagccuucgaagcgacagugcgaggagcaaaaagaauggccguacuaggagacacagcaugggauuucggcucgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 9641 - protein, 695 aa, Artificial Sequence
  ZIKV (strain ZikaSPH2015) prME-short variant
MAISGVPVLGFFIIAVLMSAQESWAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9642 - protein, 695 aa, Artificial Sequence
  ZIKV (isolate Z1106033) prME-short variant
MAISGVPVLGFFIIAVLMSAQESWAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9643 - protein, 691 aa, Artificial Sequence
  ZIKV (strain MR 766) prME-short variant
MAISGVPVLGFFIIAVLMSAQESWAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9644 - protein, 695 aa, Artificial Sequence
  ZIKV (strain NatalRGN) prME-short variant
MAISGVPVLGFFIIAVLMSAQESWAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9645 - protein, 688 aa, Artificial Sequence
  ZIKV (strain ZikaSPH2015) prME-short variant
MDWTWILFLVAAATRVHSVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9646 - protein, 688 aa, Artificial Sequence
  ZIKV (isolate Z1106033) prME-short variant
MDWTWILFLVAAATRVHSVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9647 - protein, 684 aa, Artificial Sequence
  ZIKV (strain MR 766) prME-short variant
MDWTWILFLVAAATRVHSITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9648 - protein, 688 aa, Artificial Sequence
  ZIKV (strain NatalRGN) prME-short variant
MDWTWILFLVAAATRVHSVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9649 - protein, 694 aa, Artificial Sequence
  ZIKV (strain ZikaSPH2015) prME-short variant
MGKRSAGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9650 - protein, 694 aa, Artificial Sequence
  ZIKV (isolate Z1106033) prME-short variant
MGKRSAGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9651 - protein, 690 aa, Artificial Sequence
  ZIKV (strain MR 766) prME-short variant
MGKRSAGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9652 - protein, 694 aa, Artificial Sequence
  ZIKV (strain NatalRGN) prME-short variant
MGKRSAGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9653 - protein, 695 aa, Artificial Sequence
  ZIKV (strain ZikaSPH2015) prME-short variant
MAISGVPVLGFFIIAVLMSAQESWAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9654 - protein, 695 aa, Artificial Sequence
  ZIKV (isolate Z1106033) prME-short variant
MAISGVPVLGFFIIAVLMSAQESWAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9655 - protein, 691 aa, Artificial Sequence
  ZIKV (strain MR 766) prME-short variant
MAISGVPVLGFFIIAVLMSAQESWAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9656 - protein, 695 aa, Artificial Sequence
  ZIKV (strain NatalRGN) prME-short variant
MAISGVPVLGFFIIAVLMSAQESWAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9657 - protein, 688 aa, Artificial Sequence
  ZIKV (strain ZikaSPH2015) prME-short variant
MDWTWILFLVAAATRVHSVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9658 - protein, 688 aa, Artificial Sequence
  ZIKV (isolate Z1106033) prME-short variant
MDWTWILFLVAAATRVHSVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9659 - protein, 684 aa, Artificial Sequence
  ZIKV (strain MR 766) prME-short variant
MDWTWILFLVAAATRVHSITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9660 - protein, 688 aa, Artificial Sequence
  ZIKV (strain NatalRGN) prME-short variant
MDWTWILFLVAAATRVHSVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9661 - protein, 694 aa, Artificial Sequence
  ZIKV (strain ZikaSPH2015) prME-short variant
MGKRSAGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9662 - protein, 694 aa, Artificial Sequence
  ZIKV (isolate Z1106033) prME-short variant
MGKRSAGSIMWLASLAVVIACAGAVTRRGSAYYMYLDRNDAGEAISFPTTLGMNKCYIQIMDLGHTCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9663 - protein, 690 aa, Artificial Sequence
  ZIKV (strain MR 766) prME-short variant
MGKRSAGSIMWLASLAVVIACAGAITRRGSAYYMYLDRSDAGKAISFATTLGVNKCHVQIMDLGHMCDATMSYECPMLDEGVEPDDVDCWCNTTSTWVVYGTCHHKKGEARRSRRAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9664 - protein, 694 aa, Artificial Sequence
  ZIKV (strain NatalRGN) prME-short variant
MGKRSAGSIMWLASLAVVIACAGAVTRRGSAYYMYLDRNDAGEAISFPTTLGMNKCYIQIMDLGHMCDATMSYECPMLDEGVEPDDVDCWCNTTSTWVVYGTCHHKKGEARRSRRAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTLGKAFSTTLKGAQRLAALGDTAWDFGSIGGVFNSIGRAVHQVFGGAFRTLFGGMSWITQGLMGALLLWMGVNARDRSIALAFLATGGVLVFLATNVHA

SEQ ID NO: 9665 - protein, 595 aa, Artificial Sequence
  ZIKV (strain ZikaSPH2015) ME variant
MTSVGIVGLLLTTAMAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9666 - protein, 595 aa, Artificial Sequence
  ZIKV (isolate Z1106033) ME variant
MTSVGIVGLLLTTAMAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9667 - protein, 591 aa, Artificial Sequence
  ZIKV (strain MR 766) ME variant
MTSIGIIGLLLTTAMAAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9668 - protein, 595 aa, Artificial Sequence
  ZIKV (strain NatalRGN) ME variant
MTSVGIVGLLLTTAMAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9669 - protein, 604 aa, Artificial Sequence
  ZIKV (strain ZikaSPH2015) ME variant
MAISGVPVLGFFIIAVLMSAQESWAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9670 - protein, 604 aa, Artificial Sequence
  ZIKV (isolate Z1106033) ME variant
MAISGVPVLGFFIIAVLMSAQESWAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9671 - protein, 600 aa, Artificial Sequence
  ZIKV (strain MR 766) ME variant
MAISGVPVLGFFIIAVLMSAQESWAAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9672 - protein, 604 aa, Artificial Sequence
  ZIKV (strain NatalRGN) ME variant
MAISGVPVLGFFIIAVLMSAQESWAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9673 - protein, 597 aa, Artificial Sequence
  ZIKV (strain ZikaSPH2015) ME variant
MDWTWILFLVAAATRVHSAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9674 - protein, 597 aa, Artificial Sequence
  ZIKV (isolate Z1106033) ME variant
MDWTWILFLVAAATRVHSAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9675 - protein, 593 aa, Artificial Sequence
  ZIKV (strain MR 766) ME variant
MDWTWILFLVAAATRVHSAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9676 - protein, 597 aa, Artificial Sequence
  ZIKV (strain NatalRGN) ME variant
MDWTWILFLVAAATRVHSAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9677 - protein, 603 aa, Artificial Sequence
  ZIKV (strain ZikaSPH2015) ME variant
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDIVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9678 - protein, 603 aa, Artificial Sequence
  ZIKV (isolate Z1106033) ME variant
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNAKNGSISLMCLALGGVLIFLSTAVSA

SEQ ID NO: 9679 - protein, 599 aa, Artificial Sequence
  ZIKV (strain MR 766) ME variant
MGKRSAGSIMWLASLAVVIACAGAAVTLPSHSTRKLQTRSQTWLESREYTKHLIKVENWIFRNPGFALVAVAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFTCSKKMTGKSIQPENLEYRIMLSVHGSQHSGMIGYETDEDRAKVEVTPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLFSGHLKCRLKMDKLRLKGVSYSLCTAAFTFTKVPAETLHGTVTVEVQYAGTDGPCKIPVQMAVDMQTLTPVGRLITANPVITESTENSKMMLELDPPFGDSYIVIGVGDKKITHHWHRSGSTIGKAFEATVRGAKRMAVLGDTAWDFGSVGGVFNSLGKGIHQIFGAAFKSLFGGMSWFSQILIGTLLVWLGLNTKNGSISLTCLALGGVMIFLSTAVSA

SEQ ID NO: 9680 - protein, 603 aa, Artificial Sequence
  ZIKV (strain NatalRGN) ME variant
MGKRSAGSIMWLASLAVVIACAGAAVTLPSHSTRKLQTRSQTWLESREYTKHLIRVENWIFRNPGFALAAAAIAWLLGSSTSQKVIYLVMILLIAPAYSIRCIGVSNRDFVEGMSGGTWVDVVLEHGGCVTVMAQDKPTVDIELVTTTVSNMAEVRSYCYEASISDMASDSRCPTQGEAYLDKQSDTQYVCKRTLVDRGWGNGCGLFGKGSLVTCAKFACSKKMTGKSIQPENLEYRIMLSVHGSQHSGMIVNDTGHETDENRAKVEITPNSPRAEATLGGFGSLGLDCEPRTGLDFSDLYYLTMNNKHWLVHKEWFHDIPLPWHAGADTGTPHWNNKEALVEFKDAHAKRQTVVVLGSQEGAVHTALAGALEAEMDGAKGRLSSGHLKCRLKMDKLRLKGVSYSLCTAAFTFTKIPAETLHGTVTVEVQYAGTDGPCKVPAQMAVDMQTLTPVGRLITANPVITESTENSKMMLELDPPFGDSYIVIGVGEKKITHHWHRSGSTIGKAFEATVRGAKRMAVLGDTAWDFGSVGGALNSLGKGIHQIFGAAFKSLFGGMSWFSQILIGTLLMWLGLNTKNGSISLMCLALGGVLIFLSTAVSA

SEQ ID NO: 9681 - RNA, 2085 nt, Artificial Sequence
  ZIKV (strain ZikaSPH2015) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9682 - RNA, 2085 nt, Artificial Sequence
  ZIKV (isolate Z1106033) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9683 - RNA, 2073 nt, Artificial Sequence
  ZIKV (strain MR 766) prME-short variant CDS wild type
auggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9684 - RNA, 2085 nt, Artificial Sequence
  ZIKV (strain NatalRGN) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9685 - RNA, 2064 nt, Artificial Sequence
  ZIKV (strain ZikaSPH2015) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9686 - RNA, 2064 nt, Artificial Sequence
  ZIKV (isolate Z1106033) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9687 - RNA, 2052 nt, Artificial Sequence
  ZIKV (strain MR 766) prME-short variant CDS wild type
auggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9688 - RNA, 2064 nt, Artificial Sequence
  ZIKV (strain NatalRGN) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9689 - RNA, 2082 nt, Artificial Sequence
  ZIKV (strain ZikaSPH2015) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9690 - RNA, 2082 nt, Artificial Sequence
  ZIKV (isolate Z1106033) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9691 - RNA, 2070 nt, Artificial Sequence
  ZIKV (strain MR 766) prME-short variant CDS wild type
auggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9692 - RNA, 2082 nt, Artificial Sequence
  ZIKV (strain NatalRGN) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9693 - RNA, 2085 nt, Artificial Sequence
  ZIKV (strain ZikaSPH2015) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9694 - RNA, 2085 nt, Artificial Sequence
  ZIKV (isolate Z1106033) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9695 - RNA, 2073 nt, Artificial Sequence
  ZIKV (strain MR 766) prME-short variant CDS wild type
auggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9696 - RNA, 2085 nt, Artificial Sequence
  ZIKV (strain NatalRGN) prME-short variant CDS wild type
auggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9697 - RNA, 2064 nt, Artificial Sequence
  ZIKV (strain ZikaSPH2015) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9698 - RNA, 2064 nt, Artificial Sequence
  ZIKV (isolate Z1106033) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9699 - RNA, 2052 nt, Artificial Sequence
  ZIKV (strain MR 766) prME-short variant CDS wild type
auggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9700 - RNA, 2064 nt, Artificial Sequence
  ZIKV (strain NatalRGN) prME-short variant CDS wild type
auggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9701 - RNA, 2082 nt, Artificial Sequence
  ZIKV (strain ZikaSPH2015) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9702 - RNA, 2082 nt, Artificial Sequence
  ZIKV (isolate Z1106033) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9703 - RNA, 2070 nt, Artificial Sequence
  ZIKV (strain MR 766) prME-short variant CDS wild type
auggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9704 - RNA, 2082 nt, Artificial Sequence
  ZIKV (strain NatalRGN) prME-short variant CDS wild type
auggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgcc

SEQ ID NO: 9705 - RNA, 1785 nt, Artificial Sequence
  ZIKV (strain ZikaSPH2015) ME variant CDS wild type
augaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9706 - RNA, 1785 nt, Artificial Sequence
  ZIKV (isolate Z1106033) ME variant CDS wild type
augacgagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9707 - RNA, 1773 nt, Artificial Sequence
  ZIKV (strain MR 766) ME variant CDS wild type
augaccagcaucggaaucauuggccuccugcugacuacagccauggcagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9708 - RNA, 1785 nt, Artificial Sequence
  ZIKV (strain NatalRGN) ME variant CDS wild type
augaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9709 - RNA, 1812 nt, Artificial Sequence
  ZIKV (strain ZikaSPH2015) ME variant CDS wild type
auggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9710 - RNA, 1812 nt, Artificial Sequence
  ZIKV (isolate Z1106033) ME variant CDS wild type
auggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9711 - RNA, 1800 nt, Artificial Sequence
  ZIKV (strain MR 766) ME variant CDS wild type
auggccauaaguggagucccugugcuaggauuuuucaucauagcugugcugaugagcgcucaggaaucaugggcugccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9712 - RNA, 1812 nt, Artificial Sequence
  ZIKV (strain NatalRGN) ME variant CDS wild type
auggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9713 - RNA, 1791 nt, Artificial Sequence
  ZIKV (strain ZikaSPH2015) ME variant CDS wild type
auggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9714 - RNA, 1791 nt, Artificial Sequence
  ZIKV (isolate Z1106033) ME variant CDS wild type
auggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9715 - RNA, 1779 nt, Artificial Sequence
  ZIKV (strain MR 766) ME variant CDS wild type
auggacuggaccuggauccuguuccucguggccgccgcgacccgcguccacagcgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9716 - RNA, 1791 nt, Artificial Sequence
  ZIKV (strain NatalRGN) ME variant CDS wild type
auggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9717 - RNA, 1809 nt, Artificial Sequence
  ZIKV (strain ZikaSPH2015) ME variant CDS wild type
auggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcu

SEQ ID NO: 9718 - RNA, 1809 nt, Artificial Sequence
  ZIKV (isolate Z1106033) ME variant CDS wild type
auggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcu

SEQ ID NO: 9719 - RNA, 1797 nt, Artificial Sequence
  ZIKV (strain MR 766) ME variant CDS wild type
auggguaaacggagcgcuggcucaaucauguggcucgcgagcuuggcaguugucauagcuugugcaggagccgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcu

SEQ ID NO: 9720 - RNA, 1809 nt, Artificial Sequence
  ZIKV (strain NatalRGN) ME variant CDS wild type
auggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcu

SEQ ID NO: 9721 - RNA, 2085 nt, Artificial Sequence
  ZIKV (strain ZikaSPH2015) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9722 - RNA, 2085 nt, Artificial Sequence
  ZIKV (isolate Z1106033) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9723 - RNA, 2073 nt, Artificial Sequence
  ZIKV (strain MR 766) prME-short variant CDS opt
auggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9724 - RNA, 2085 nt, Artificial Sequence
  ZIKV (strain NatalRGN) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9725 - RNA, 2064 nt, Artificial Sequence
  ZIKV (strain ZikaSPH2015) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9726 - RNA, 2064 nt, Artificial Sequence
  ZIKV (isolate Z1106033) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9727 - RNA, 2052 nt, Artificial Sequence
  ZIKV (strain MR 766) prME-short variant CDS opt
auggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9728 - RNA, 2064 nt, Artificial Sequence
  ZIKV (strain NatalRGN) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9729 - RNA, 2082 nt, Artificial Sequence
  ZIKV (strain ZikaSPH2015) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9730 - RNA, 2082 nt, Artificial Sequence
  ZIKV (isolate Z1106033) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9731 - RNA, 2070 nt, Artificial Sequence
  ZIKV (strain MR 766) prME-short variant CDS opt
augggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9732 - RNA, 2082 nt, Artificial Sequence
  ZIKV (strain NatalRGN) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9733 - RNA, 2085 nt, Artificial Sequence
  ZIKV (strain ZikaSPH2015) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9734 - RNA, 2085 nt, Artificial Sequence
  ZIKV (isolate Z1106033) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9735 - RNA, 2073 nt, Artificial Sequence
  ZIKV (strain MR 766) prME-short variant CDS opt
auggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9736 - RNA, 2085 nt, Artificial Sequence
  ZIKV (strain NatalRGN) prME-short variant CDS opt
auggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9737 - RNA, 2064 nt, Artificial Sequence
  ZIKV (strain ZikaSPH2015) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9738 - RNA, 2064 nt, Artificial Sequence
  ZIKV (isolate Z1106033) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9739 - RNA, 2052 nt, Artificial Sequence
  ZIKV (strain MR 766) prME-short variant CDS opt
auggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9740 - RNA, 2064 nt, Artificial Sequence
  ZIKV (strain NatalRGN) prME-short variant CDS opt
auggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9741 - RNA, 2082 nt, Artificial Sequence
  ZIKV (strain ZikaSPH2015) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9742 - RNA, 2082 nt, Artificial Sequence
  ZIKV (isolate Z1106033) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9743 - RNA, 2070 nt, Artificial Sequence
  ZIKV (strain MR 766) prME-short variant CDS opt
augggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9744 - RNA, 2082 nt, Artificial Sequence
  ZIKV (strain NatalRGN) prME-short variant CDS opt
augggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgcc

SEQ ID NO: 9745 - RNA, 1785 nt, Artificial Sequence
  ZIKV (strain ZikaSPH2015) ME variant CDS opt
augaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9746 - RNA, 1785 nt, Artificial Sequence
  ZIKV (isolate Z1106033) ME variant CDS opt
augaccagcguggggaucgugggccuccugcugacgaccgccauggcggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9747 - RNA, 1773 nt, Artificial Sequence
  ZIKV (strain MR 766) ME variant CDS opt
augaccagcaucgggaucaucggccugcugcucacgaccgccauggcggccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9748 - RNA, 1785 nt, Artificial Sequence
  ZIKV (strain NatalRGN) ME variant CDS opt
augaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9749 - RNA, 1812 nt, Artificial Sequence
  ZIKV (strain ZikaSPH2015) ME variant CDS opt
auggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9750 - RNA, 1812 nt, Artificial Sequence
  ZIKV (isolate Z1106033) ME variant CDS opt
auggccaucagcggcgugcccguccugggguucuucaucaucgccgugcucauguccgcgcaggagagcugggccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9751 - RNA, 1800 nt, Artificial Sequence
  ZIKV (strain MR 766) ME variant CDS opt
auggccaucagcggcgugcccguccugggguucuucaucaucgccgugcucauguccgcgcaggagagcugggccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9752 - RNA, 1812 nt, Artificial Sequence
  ZIKV (strain NatalRGN) ME variant CDS opt
auggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9753 - RNA, 1791 nt, Artificial Sequence
  ZIKV (strain ZikaSPH2015) ME variant CDS opt
auggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9754 - RNA, 1791 nt, Artificial Sequence
  ZIKV (isolate Z1106033) ME variant CDS opt
auggacuggaccuggauccuguuccucguggccgccgcgacccgcguccacagcgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9755 - RNA, 1779 nt, Artificial Sequence
  ZIKV (strain MR 766) ME variant CDS opt
auggacuggaccuggauccuguuccucguggccgccgcgacccgcguccacagcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9756 - RNA, 1791 nt, Artificial Sequence
  ZIKV (strain NatalRGN) ME variant CDS opt
auggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9757 - RNA, 1809 nt, Artificial Sequence
  ZIKV (strain ZikaSPH2015) ME variant CDS opt
augggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgcc

SEQ ID NO: 9758 - RNA, 1809 nt, Artificial Sequence
  ZIKV (isolate Z1106033) ME variant CDS opt
augggcaagcgcagcgccggguccaucauguggcuggccagccucgcgguggucaucgccugcgccggcgccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgcc

SEQ ID NO: 9759 - RNA, 1797 nt, Artificial Sequence
  ZIKV (strain MR 766) ME variant CDS opt
augggcaagcgcagcgccggguccaucauguggcuggccagccucgcgguggucaucgccugcgccggcgccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgcc

SEQ ID NO: 9760 - RNA, 1809 nt, Artificial Sequence
  ZIKV (strain NatalRGN) ME variant CDS opt
augggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgcc

SEQ ID NO: 9761 - RNA, 2085 nt, Artificial Sequence
  ZIKV (strain ZikaSPH2015) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9762 - RNA, 2085 nt, Artificial Sequence
  ZIKV (isolate Z1106033) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9763 - RNA, 2073 nt, Artificial Sequence
  ZIKV (strain MR 766) prME-short variant CDS opt
auggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9764 - RNA, 2085 nt, Artificial Sequence
  ZIKV (strain NatalRGN) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9765 - RNA, 2064 nt, Artificial Sequence
  ZIKV (strain ZikaSPH2015) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9766 - RNA, 2064 nt, Artificial Sequence
  ZIKV (isolate Z1106033) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9767 - RNA, 2052 nt, Artificial Sequence
  ZIKV (strain MR 766) prME-short variant CDS opt
auggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9768 - RNA, 2064 nt, Artificial Sequence
  ZIKV (strain NatalRGN) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9769 - RNA, 2082 nt, Artificial Sequence
  ZIKV (strain ZikaSPH2015) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9770 - RNA, 2082 nt, Artificial Sequence
  ZIKV (isolate Z1106033) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9771 - RNA, 2070 nt, Artificial Sequence
  ZIKV (strain MR 766) prME-short variant CDS opt
augggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9772 - RNA, 2082 nt, Artificial Sequence
  ZIKV (strain NatalRGN) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9773 - RNA, 2085 nt, Artificial Sequence
  ZIKV (strain ZikaSPH2015) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9774 - RNA, 2085 nt, Artificial Sequence
  ZIKV (isolate Z1106033) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9775 - RNA, 2073 nt, Artificial Sequence
  ZIKV (strain MR 766) prME-short variant CDS opt
auggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9776 - RNA, 2085 nt, Artificial Sequence
  ZIKV (strain NatalRGN) prME-short variant CDS opt
auggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9777 - RNA, 2064 nt, Artificial Sequence
  ZIKV (strain ZikaSPH2015) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9778 - RNA, 2064 nt, Artificial Sequence
  ZIKV (isolate Z1106033) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9779 - RNA, 2052 nt, Artificial Sequence
  ZIKV (strain MR 766) prME-short variant CDS opt
auggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9780 - RNA, 2064 nt, Artificial Sequence
  ZIKV (strain NatalRGN) prME-short variant CDS opt
auggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9781 - RNA, 2082 nt, Artificial Sequence
  ZIKV (strain ZikaSPH2015) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9782 - RNA, 2082 nt, Artificial Sequence
  ZIKV (isolate Z1106033) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9783 - RNA, 2070 nt, Artificial Sequence
  ZIKV (strain MR 766) prME-short variant CDS opt
augggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9784 - RNA, 2082 nt, Artificial Sequence
  ZIKV (strain NatalRGN) prME-short variant CDS opt
augggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgcc

SEQ ID NO: 9785 - RNA, 1785 nt, Artificial Sequence
  ZIKV (strain ZikaSPH2015) ME variant CDS opt
augaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9786 - RNA, 1785 nt, Artificial Sequence
  ZIKV (isolate Z1106033) ME variant CDS opt
augaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9787 - RNA, 1773 nt, Artificial Sequence
  ZIKV (strain MR 766) ME variant CDS opt
augaccuccaucggcaucaucggccuccuccucaccaccgccauggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9788 - RNA, 1785 nt, Artificial Sequence
  ZIKV (strain NatalRGN) ME variant CDS opt
augaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9789 - RNA, 1812 nt, Artificial Sequence
  ZIKV (strain ZikaSPH2015) ME variant CDS opt
auggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9790 - RNA, 1812 nt, Artificial Sequence
  ZIKV (isolate Z1106033) ME variant CDS opt
auggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9791 - RNA, 1800 nt, Artificial Sequence
  ZIKV (strain MR 766) ME variant CDS opt
auggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9792 - RNA, 1812 nt, Artificial Sequence
  ZIKV (strain NatalRGN) ME variant CDS opt
auggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9793 - RNA, 1791 nt, Artificial Sequence
  ZIKV (strain ZikaSPH2015) ME variant CDS opt
auggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9794 - RNA, 1791 nt, Artificial Sequence
  ZIKV (isolate Z1106033) ME variant CDS opt
auggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9795 - RNA, 1779 nt, Artificial Sequence
  ZIKV (strain MR 766) ME variant CDS opt
auggacuggaccuggauccucuuccucgucgccgccgccacccgcguccacuccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9796 - RNA, 1791 nt, Artificial Sequence
  ZIKV (strain NatalRGN) ME variant CDS opt
auggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9797 - RNA, 1809 nt, Artificial Sequence
  ZIKV (strain ZikaSPH2015) ME variant CDS opt
augggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9798 - RNA, 1809 nt, Artificial Sequence
  ZIKV (isolate Z1106033) ME variant CDS opt
augggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgcc

SEQ ID NO: 9799 - RNA, 1797 nt, Artificial Sequence
  ZIKV (strain MR 766) ME variant CDS opt
augggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgcc

SEQ ID NO: 9800 - RNA, 1809 nt, Artificial Sequence
  ZIKV (strain NatalRGN) ME variant CDS opt
augggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgcc

SEQ ID NO: 9801 - RNA, 2085 nt, Artificial Sequence
  ZIKV (strain ZikaSPH2015) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgaucggaaaggccuucgaagcuaccgugcgcggugccaaaagaauggcaguacuaggcgauacugcuugggacuuuggguccgugggaggcgcccucaauucucuggguaaggggauucaccaaaucuucggcgcggccuuuaaaucgcuuuucggaggcaugagcugguuuucccagauuuugauagggacacugcucauguggcugggacuuaacaccaagaauggcucaaucagucugauguguuuggcucucggugggguucugauuuucuuaucuacagcagucagcgcc

SEQ ID NO: 9802 - RNA, 2085 nt, Artificial Sequence
  ZIKV (isolate Z1106033) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcaccaucggaaaggccuucgaagcuacuguacgcggugccaaaagaauggcagugcuaggcgauacagcuugggacuuuggguccguuggaggcgcccucaauucucuggguaaggggauccaccaaauuuucggcgcggccuuuaaaucgcuuuucggaggcaugagcugguuuucccagaucuugauugggacccugcucauguggcugggacuuaacgcuaagaauggcucaauaagucugauguguuuggcacucggugggguccugaucuucuuaucuacagccgugagcgcu

SEQ ID NO: 9803 - RNA, 2073 nt, Artificial Sequence
  ZIKV (strain MR 766) prME-short variant CDS opt
auggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgauuggaaaggcuuuugaggccaccgugcggggugcaaaacgcauggccgugcuaggcgacacugcuugggauuucggguccgucggaggcguuuuuaauucucucgguaaggggauccaccaaaucuucggcgccgcauuuaaaucgcuguucggaggcaugagcugguuuucccagauucuuaucgggacauugcugguguggcucggacugaacaccaagaacggcucaauuagucuuacaugucuggcuuuggguggggugaugauauuccucucuacugccguaagcgcg

SEQ ID NO: 9804 - RNA, 2085 nt, Artificial Sequence
  ZIKV (strain NatalRGN) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgaucggaaaggccuucgaagcuaccguacgcggugccaaaagaauggcagugcuaggcgauacugcuugggacuuuggguccguuggaggcgcccucaauucucuggguaaggggauccaccaaauuuucggcgcggccuuuaaaucgcuuuucggaggcaugagcugguuuucccagaucuugauugggacacugcucauguggcugggacuuaacaccaagaauggcucaauaagucugauguguuuggcucucggugggguccugaucuucuuaucuacagcagugagcgcc

SEQ ID NO: 9805 - RNA, 2064 nt, Artificial Sequence
  ZIKV (strain ZikaSPH2015) prME-short variant CDS opt
auggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacuauuggcaaggcauucgaggccacagucagaggggcuaaaaggauggccgugcuaggagacaccgcaugggauuucgguaguguaggcggggcucucaauagccugggaaagggcauccaucagaucuuuggugccgcguucaaaucccuuuuugggggcaugucuugguucucgcaaauuuugaucggaacacugcucauguggcugggccuuaacacuaagaaugggagcauuucccugauguguuuggcccucggaggcgugcugauauuuuuaucaaccgcuguuagugca

SEQ ID NO: 9806 - RNA, 2064 nt, Artificial Sequence
  ZIKV (isolate Z1106033) prME-short variant CDS opt
auggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacaauaggcaaggcauucgaggccaccgugagaggggcuaaaaggauggccguacuaggagacacagcaugggauuucgguagugugggcggggcucucaauagccugggaaagggcauucaucagaucuuuggugccgcguucaaaucccuuuuugggggcaugucuugguucucgcaaaucuugauuggaacucugcucauguggcugggccuuaacgccaagaaugggagcaucucccugauguguuuggcucucggaggcguucugaucuuuuuaucaaccgcagucagugcc

SEQ ID NO: 9807 - RNA, 2052 nt, Artificial Sequence
  ZIKV (strain MR 766) prME-short variant CDS opt
auggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacuaucggcaaggcguucgaagcuacaguccgcggggccaaaagaauggcagugcuaggagauaccgccugggacuuugguagugugggcggggucuucaauagccucggaaagggcauacaucagauuuuuggugcugccuucaaaucccuguuugggggcaugucuugguucucgcaaauccuuaucggaacauugcugguuuggcucggccugaacacuaagaacgggagcauuucccuuaccugucuggcauugggaggcgugaugaucuuucucucaacggcugugagugcc

SEQ ID NO: 9808 - RNA, 2064 nt, Artificial Sequence
  ZIKV (strain NatalRGN) prME-short variant CDS opt
auggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacuauaggcaaggcauucgaggccacagugagaggggcuaaaaggauggccguacuaggagacaccgcaugggauuucgguagugugggcggggcucucaauagccugggaaagggcauucaucagaucuuuggugccgcguucaaaucccuuuuugggggcaugucuugguucucgcaaaucuugauuggaacacugcucauguggcugggccuuaacacuaagaaugggagcaucucccugauguguuuggcccucggaggcguucugaucuuuuuaucaaccgcugucagugca

SEQ ID NO: 9809 - RNA, 2082 nt, Artificial Sequence
  ZIKV (strain ZikaSPH2015) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgaucgguaaagccuuugaggcaaccgucagaggcgcuaagaggauggccgugcuaggggauacugcgugggacuucggauccguaggcggugcccucaauucucuggggaaaggcauccaccagauuuucggagcugcauuuaagucgcuuuucggcgggaugagcugguuuucccaaaucuugauuggaacacugcucauguggcugggccuuaacaccaaaaaugguucaauaagucugaugugcuuggcccucgggggagugcugaucuucuuaucuacagcuguuagcgcc

SEQ ID NO: 9810 - RNA, 2082 nt, Artificial Sequence
  ZIKV (isolate Z1106033) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcaccauugguaaagccuuugaggcaacugugagaggcgcuaagaggauggccguacuaggggauacagcgugggacuucggauccgugggcggugcccucaauucucuggggaaaggcauccaccagaucuucggagcugcauuuaagucgcuuuucggcgggaugagcugguuuucccaaauuuugaucggaacccugcucauguggcugggccuuaacgccaaaaaugguucaauuagucugaugugcuuggcucucgggggaguucugauauucuuaucuacagccgucagcgca

SEQ ID NO: 9811 - RNA, 2070 nt, Artificial Sequence
  ZIKV (strain MR 766) prME-short variant CDS opt
augggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcugggaggguucggcucccuuggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgauagguaaagcauucgaagccaccguccgcggcgcuaagagaauggccgugcuaggggacacugcaugggauuucggauccgugggcggugucuuuaauucucucgggaaaggcauucaccagaucuucggagcugccuuuaagucgcuguucggcgggaugagcugguuuucccaaauccuuauuggaacauugcugguuuggcucggccugaacaccaagaacgguucaaucagucuuacaugccuggcgcucgggggagugaugauuuucuugucuacugccgugagcgcu

SEQ ID NO: 9812 - RNA, 2082 nt, Artificial Sequence
  ZIKV (strain NatalRGN) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgauugguaaagccuuugaggcaaccgugagaggcgcuaagaggauggccguacuaggggauacugcgugggacuucggauccgugggcggugcccucaauucucuggggaaaggcauccaccagaucuucggagcugcauuuaagucgcuuuucggcgggaugagcugguuuucccaaauuuugaucggaacacugcucauguggcugggccuuaacaccaaaaaugguucaauuagucugaugugcuuggcccucgggggaguucugauauucuuaucuacagcugucagcgcc

SEQ ID NO: 9813 - RNA, 2085 nt, Artificial Sequence
  ZIKV (strain ZikaSPH2015) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgcuaggaaaggccuucuccaccacucucaaaggugcucaacgccuggccgcacuuggcgauacagcuugggacuuugggucuaucggaggcguguucaauucgauugguagagccguacaccagguguuugggggcgcguucaggaccuuguuuggaggcaugagcuggaucacacaggggcugaugggagcccuccugcuuuggaugggcguuaacgcucgugaucgguccauugcacuggccuucuuggcuacuggugggguccucguguuucuggccaccaaugugcaugca

SEQ ID NO: 9814 - RNA, 2085 nt, Artificial Sequence
  ZIKV (isolate Z1106033) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcacccuaggaaaggccuucuccacuacacucaaaggugcucaacgccuggccgcacuuggcgauaccgcuugggacuuugggucuaucggaggcguauucaauucgaucgguagagccgugcaccagguuuuugggggcgcguucaggacauuguuuggaggcaugagcuggauuacucaggggcugaugggagcccuccugcuuuggaugggcgucaacgcucgugaucgguccaucgcacuggccuucuuggcuaccgguggggugcucguguuucuggccacgaauguccaugca

SEQ ID NO: 9815 - RNA, 2073 nt, Artificial Sequence
  ZIKV (strain MR 766) prME-short variant CDS opt
auggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgcuaggaaaggcuuuuuccaccacucucaaaggugcccaacggcuggcagcccuuggcgacacagcuugggauuucgggucuauuggaggcguguuuaauucgaucggucgcgccgugcaccaggucuucgggggcgcauuuagaaccuuguucggaggcaugagcuggaucacacaggggcugaugggagcucuccugcuuuggaugggcguuaacgccagggaccguuccauugcgcuggccuuuuuggcuacugguggggugcucguguuccuggcaaccaacguacaugcc

SEQ ID NO: 9816 - RNA, 2085 nt, Artificial Sequence
  ZIKV (strain NatalRGN) prME-short variant CDS opt
auggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgcuaggaaaggccuucuccaccacucucaaaggugcucaacgccuggccgcacuuggcgauacagcuugggacuuugggucuaucggaggcguauucaauucgaucgguagagccgugcaccagguuuuugggggcgcguucaggaccuuguuuggaggcaugagcuggauuacacaggggcugaugggagcccuccugcuuuggaugggcgucaacgcucgugaucgguccaucgcacuggccuucuuggcuacugguggggugcucguguuucuggccaccaauguccaugca

SEQ ID NO: 9817 - RNA, 2064 nt, Artificial Sequence
  ZIKV (strain ZikaSPH2015) prME-short variant CDS opt
auggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacucuaggcaaggcauucaguacaacccucaaaggggcccagagacuggcugcccuuggagacacagcaugggauuucgguagcauuggcggggucuuuaauuccaucggaagggcugugcaucaaguauucggcggugccuuucguacuuuguucgggggcaugucuuggaucacccagggacugaugggcgcgcuccugcuuuggaugggggugaacgcccgggaccgaucgauugcucuggcauuuuuggccacgggaggcguucucgucuuccuggcuaccaaugugcacgcc

SEQ ID NO: 9818 - RNA, 2064 nt, Artificial Sequence
  ZIKV (isolate Z1106033) prME-short variant CDS opt
auggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacacuaggcaaggcauucaguaccacacucaaaggggcccagagacuggcugcccuuggagacacugcaugggauuucgguagcauaggcgggguguuuaauuccauuggaagggcuguacaucaaguguucggcggugccuuucguaccuuguucgggggcaugucuuggaucacgcagggacugaugggcgcgcuccugcuuuggauggggguuaacgcccgggaccgaucgaucgcucuggcauuuuuggccaccggaggcguccucguguuccuggcuacaaaugugcacgcc

SEQ ID NO: 9819 - RNA, 2052 nt, Artificial Sequence
  ZIKV (strain MR 766) prME-short variant CDS opt
auggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacucuaggcaaggcguucaguacaacccucaaaggggcucagcgccuggccgcacuuggagauacagccugggacuuugguagcaucggcggggucuucaauuccauaggcagagcugugcaucaaguguuuggaggugccuucaggacuuuguuugggggcaugucuuggauuacccagggacugaugggcgcacuccugcuuuggaugggggucaacgcucgugaucggucgaucgcccuggcguucuuggccacgggaggcguucucguguuucuggcuaccaacgugcacgca

SEQ ID NO: 9820 - RNA, 2064 nt, Artificial Sequence
  ZIKV (strain NatalRGN) prME-short variant CDS opt
auggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacucuaggcaaggcauucaguacaacccucaaaggggcccagagacuggcugcccuuggagacacagcaugggauuucgguagcauaggcgggguguuuaauuccauuggaagggcuguacaucaaguguucggcggugccuuucguacuuuguucgggggcaugucuuggaucacccagggacugaugggcgcgcuccugcuuuggauggggguuaacgcccgggaccgaucgaucgcucuggcauuuuuggccacgggaggcguccucguguuccuggcuaccaaugugcacgcc

SEQ ID NO: 9821 - RNA, 2082 nt, Artificial Sequence
  ZIKV (strain ZikaSPH2015) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgcuagguaaagccuuuuccaccacucucaagggcgcacagagacuggcugcccuuggggauacagcgugggacuucggaucuaucggcggugucuucaauucgaucgggagggccgugcaccaaguauuuggcggagcuuuccguaccuuguuuggcgggaugagcuggauuacacagggacugaugggcgcacuccugcuuuggaugggugugaacgcccgggaucgauccaucgcucuggccuucuuggcaacugggggaguucucgucuuucuggcgaccaaugugcaugcc

SEQ ID NO: 9822 - RNA, 2082 nt, Artificial Sequence
  ZIKV (isolate Z1106033) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcacccuagguaaagccuuuuccacuacacucaagggcgcacagagacuggcugcccuuggggauaccgcgugggacuucggaucuauuggcgguguguucaauucgaucgggagggccguacaccaaguguuuggcggagcuuuccguacauuguuuggcgggaugagcuggaucacucagggacugaugggcgcacuccugcuuuggauggguguuaacgcccgggaucgauccauugcucuggccuucuuggcaaccgggggaguccucguguuucuggcgacgaaugugcaugcc

SEQ ID NO: 9823 - RNA, 2070 nt, Artificial Sequence
  ZIKV (strain MR 766) prME-short variant CDS opt
augggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcuugggggauucggcucccugggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgcuagguaaagcauucuccaccacucucaagggcgcccagcgccuggcugcccuuggggacacagcaugggauuucggaucuauaggcggugucuuuaauucgauugggagagcugugcaccaaguguucggcggagccuuuaggaccuuguucggcgggaugagcuggaucacacagggacugaugggcgcgcuccugcuuuggaugggugucaacgcccgugaccgguccaucgcucuggcauuuuuggccacugggggaguucucguguuccuggcuaccaacgugcaugcc

SEQ ID NO: 9824 - RNA, 2082 nt, Artificial Sequence
  ZIKV (strain NatalRGN) prME-short variant CDS opt
augggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgcuagguaaagccuuuuccaccacucucaagggcgcacagagacuggcugcccuuggggauacagcgugggacuucggaucuauuggcgguguguucaauucgaucgggagggccguacaccaaguguuuggcggagcuuuccguaccuuguuuggcgggaugagcuggaucacacagggacugaugggcgcacuccugcuuuggauggguguuaacgcccgggaucgauccauugcucuggccuucuuggcaacugggggaguccucguguuucuggcgaccaaugugcaugcc

SEQ ID NO: 9825 - RNA, 1785 nt, Artificial Sequence
  ZIKV (strain ZikaSPH2015) ME variant CDS opt
augaccagcgugggcauugucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugauaucgugcucgagcacggugggugugucacugugauggcccaggacaaaccgacaguagauauugaacugguuaccacgacugugaguaauauggcugaggucagguccuauugcuacgaggccucuaucagcgacauggcguccgauucacggugucccacccagggagaagcauaucuggacaagcaaagugauacacaguacgugugcaaacgcacucucguggacagaggcuggggcaacggguguggauuauuugguaagggcagccuggucacaugcgccaaguucgcuuguucuaaaaagaugacagggaaauccauucagccugagaaucuugaauauaggaucauguugucaguucauggaagccagcacaguggcaugauagugaacgauaccggucaugagacggacgagaaucgggccaagguagaaauuacuccaaacucuccccgcgcagaggcuacacuagggggauuuggcucccugggccucgauugcgaaccucgaaccgggcuggacuucagcgaucuuuacuaccugacuaugaauaacaaacacugguuggugcacaaggagugguuucaugacaucccacuccccuggcacgccggagcggacacagguaccccucauuggaauaacaaggaagcccuggucgaguucaaagaugcacacgcuaagagacaaacggugguuguguuaggcucgcaggagggggccguccacaccgcucuggccggagcacucgaagccgagauggacggcgcuaaagguaggcuuucuuccgggcaucugaagugucgguugaaaauggauaagcuacgucugaaaggcgugucauauagucucugcacagcggcauuuacuuucaccaagauuccagccgaaacacugcacggaacuguaaccguugaggugcaguacgcuggcacagacgggccguguaagguccccgcccagauggcaguggauaugcaaacccuuacuccugucggacgccugaucacggccaauccagugaucacagaaagcaccgagaacuccaaaaugauguuggagcucgaucccccuuuuggugacucuuauauuguuauaggcgugggggaaaagaaaaucacucaucacuggcauagaagcggaucaaccauuggcaaggcuuucgaggccacaguaaggggugcaaaacggauggcgguccugggggacaccgcuugggauuuuggcagugugggaggcgccuuaaauucccuggggaagggaauccaccagauauucggugcagccuucaagagccuauuuggcgggaugucuugguucucacagauucucaucggaacucugcuuaugugguugggccugaacaccaaaaacgguaguaucagccucaugugccuggcucuugggggcguucugaucuuuuuguccacggccgugucugca

SEQ ID NO: 9826 - RNA, 1785 nt, Artificial Sequence
  ZIKV (isolate Z1106033) ME variant CDS opt
augaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacgcuaaaaacgguaguaucagccucaugugccuggcccuugggggcgugcugaucuuuuuguccacagcagucucugcu

SEQ ID NO: 9827 - RNA, 1773 nt, Artificial Sequence
  ZIKV (strain MR 766) ME variant CDS opt
augaccagcaucggcauuauagggcugcuccuuacaacugccauggcugcagugacgcugcccucccacucuaccagaaaguugcagacaaggucacaaacuugguuagagagucgggaauacaccaaacaucugaucaaggucgagaacuggauuuuccgcaauccuggauuugcccuaguugcgguggcuaucgccuggcuccuggguagcuccacaucucagaaaguaauuuaucuugugaugauccuguugauagcaccagccuacucgauccgaugcauuggcgucucaaaccgugacuucguggaagggaugagcggaggcaccuggguugaugugguccucgagcacggugggugugugacuguaauggcucaggacaagccgacaguugauaucgaacuggugaccacgacugucaguaauauggcagaggugagauccuauugcuacgaggccucuauuagcgacauggcuuccgauucaaggugucccacccagggagaagccuaucuggacaaacaaagugauacacaguacgugugcaagcggacucucgucgaccgcggcuggggcaacggguguggauuauuugguaagggcagccugguuaccugcgcgaaauucacauguucuaagaaaaugaccgggaaguccauccagccugagaaucuugaauauagaauaauguugucagugcauggaagccagcacaguggcaugauugguuacgagacggaugaggacagggcaaaaguagaagugacuccaaacucuccccgggccgaggcuacacuugggggauuuggcucccuaggccucgauugcgaaccucgcaccgggcuggacuucagcgaucuuuacuaucugacuaugaauaacaagcauugguugguccacaaggagugguuucacgacaucccacuccccuggcaugccggagcagacacagguaccccucacuggaauaacaaagaagcucugguggaguucaaggaugcccaugcgaaacgacaaacgguuguggucuuaggcucgcaggagggggccgugcacaccgcacuggcuggagcccucgaagcugagauggacggcgccaaggguagacuguuuucugggcaccugaaauguagguugaagauggauaaacuacggcugaagggcguauccuacucacucugcacagcagccuucacuuuuaccaagguuccagcugaaacacugcauggaacugugaccgucgaggugcaguaugcgggcacagacgggccguguaaaauucccguccagauggcaguggauaugcaaacccuuacuccuguuggacgucugaucacggccaauccagugaucacagaaaguaccgagaacagcaagaugauguuggagcucgaucccccuuucggugacuccuacauuguaauaggcgucggggacaaaaagaucacucaccauuggcaccgcucuggaagcaccauuggcaaggcuuuugaagccacagugagaggugcaaaaaggauggccguucugggggauaccgcuugggacuucggcucagugggaggcgucuucaauaguuuagggaagggaauccaucagauauuuggugccgcauucaaaucccuguuuggcgggaugagcugguucucucagauucuaaucggaacucuccugguguggcuuggcuugaacacaaagaaugguucaaucagucugacgugccucgcgcuugggggcguaaugauuuuucugagcaccgcuguguccgcc

SEQ ID NO: 9828 - RNA, 1785 nt, Artificial Sequence
  ZIKV (strain NatalRGN) ME variant CDS opt
augaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacacgaaaaacgguaguaucagccucaugugccuggcucuugggggcgugcugaucuuuuuguccacagccgucucugca

SEQ ID NO: 9829 - RNA, 1812 nt, Artificial Sequence
  ZIKV (strain ZikaSPH2015) ME variant CDS opt
auggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggauaucgucuuggaacacggugggugugugaccguaauggcccaggacaaacccacaguugauauugagcucgugaccacuacagucucuaauauggcggaggugaggagcuauugcuacgaagcauccaucucagacauggccagugauagccgguguccuacccaaggagaggcuuaucuggacaagcagucugauacgcaguacgugugcaaacgcacucuggucgacagaggcuggggcaacggguguggacucuuugguaagggcuccuuaguuaccugcgccaaguucgcauguagcaaaaagaugacagggaaaucaauacagccagaaaaucuggaguauaggauuaugcuuagugugcauggaucucaacacuccggcaugaucguaaacgauacuggucaugagaccgacgaaaaucgggcuaagguggagauuacacccaacagcccucgcgccgaagcgaccuugggaggauuuggcucgcugggccuagauugcgagccacgaacggggcucgacuucucugaucuguacuaccuuacuaugaauaacaaacacuggcugguccacaaggaaugguuucaugacauccccuugccuuggcacgccggagcagacacagguaccccacauuggaauaacaaggaggcucucguggaguucaaagaugcccacgcuaagagacagacuguugugguccugggcucccaggaaggggccgugcacacagcauuagccggagcucuggaggcggaaauggacggcgcaaaagguaggcucucaagugggcaucuuaagugucggcugaaaauggauaaguugcgucuaaaaggcguaagcuauucccugugcaccgccgcuuuuacguucaccaagaucccggccgagacacuccacggaacuguuaccguggaaguccaguacgcaggcacagacgggcccuguaaggugccugcccaaauggcugucgauaugcagacucugaccccagugggacgccuuauuacagccaaucccguuauaaccgagucuacugagaacagcaaaaugaugcuggaauuggacccuccauuuggugauucauauaucgugauuggcguaggggagaagaaaaucacgcaucacuggcauagaaguggauccacaauaggcaaggcauucgaagcgaccgucaggggugcuaaacggauggccgugcucggggacacugcaugggauuucggcagcguuggaggcgccuuaaauucucuggggaaggggauucaccagaucuuuggugcugccuucaagucacuguuuggcgggaugaguugguucagccaaauccuaauuggaacccuccugauguggcuuggcuugaacaccaaaaacgguuccaucucucugaugugccucgcacuugggggcgugcugauuuuucugucgacagcugucagcgcc

SEQ ID NO: 9830 - RNA, 1812 nt, Artificial Sequence
  ZIKV (isolate Z1106033) ME variant CDS opt
auggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacgcuaaaaacgguuccauuucucugaugugccucgcacuugggggcguccugaucuuucugucgacagccgugagcgcg

SEQ ID NO: 9831 - RNA, 1800 nt, Artificial Sequence
  ZIKV (strain MR 766) ME variant CDS opt
auggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaaucaagguagaaaacuggauuuuccgcaauccaggauuugcucugguggccgucgcaaucgccuggcuacucgguucuucgacaucacagaaagugauuuaucugguuaugauccuucugauagcuccggcauacagcauccgaugcauuggcgugaguaaccgugacuucgucgaggggauguccggaggcacuuggguggauguaguuuuggaacacggugggugugugaccgucauggcccaggacaagcccacaguggauaucgagcucgugaccacuacagucucuaauauggcugagguuagaagcuauugcuacgaagccuccauuucagacauggcgagugauucuagguguccuacccaaggagaggcauaucuggacaaacagagcgauacgcaguacgugugcaagcggacucugguagaccgcggcuggggcaacggguguggacucuuugguaagggcuccuuagugaccugcgccaaauucacauguucaaagaaaaugacuggaaagagcauccagccagaaaaucuggaguauagaauaaugcuuaguguccaugggucucaacacuccggcaugauugguuacgagaccgaugaagacagggcuaaaguggagguuacacccaacagcccucgggccgaagcaaccuugggaggguuuggcucgcugggccuagauugcgagccacgcacggggcucgacuucucugaucuguacuaucuuacuaugaauaacaagcauuggcuggugcacaaggaaugguuucacgacauccccuugccuuggcaugcuggagccgacacagguaccccacacuggaauaacaaagaggcgcucgucgaguucaaggaugcccaugcaaaacgacagacugugguaguucugggcucccaggaaggggcugugcacacagccuuagcuggagcccuggaggcagaaauggacggcgccaaggguagacucuuuucagggcaccuuaaauguaggcugaagauggauaaauugcggcuaaagggcgucaguuacagccugugcaccgcugcguucacguuuaccaaggugccggcagagacacuccauggaacugucaccguggaaguucaguaugccggcacagacgggcccuguaaaauuccugugcaaauggcuguagauaugcagacucugaccccagucggacgucuuaucacagccaaucccgugaucaccgaguccacugagaacucuaagaugaugcuggaauuggacccuccauucggugauagcuacauuguuauaggcgugggggacaaaaagaucacgcaccauuggcaccgcucaggaaguacaauuggcaaagcauucgaggccaccgucagaggugcuaagaggauggccgugcucggggauacugcaugggacuuuggcuccguaggaggcguguucaauagccuggggaagggaauccaucagauauuuggugcggcuuucaaaucuuuauuuggcgggaugucaugguucagucaaauucugaucggaacccuacucguuuggcugggccuuaacacaaagaaugguagcaucuccuugaccugccuggcccucgggggcgucaugauuuuucugucuacugcagugucggcc

SEQ ID NO: 9832 - RNA, 1812 nt, Artificial Sequence
  ZIKV (strain NatalRGN) ME variant CDS opt
auggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacaccaaaaacgguuccauuucucugaugugccucgcacuugggggcguccugaucuuucugucgacagcugugagcgcc

SEQ ID NO: 9833 - RNA, 1791 nt, Artificial Sequence
  ZIKV (strain ZikaSPH2015) ME variant CDS opt
auggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacaucguguuggagcauggaggcugugucaccgugauggcucaggauaaaccgacuguagacauugaacucguuacaaccacggugaguaauauggccgagguccgguccuauugcuacgaggcgucuaucagcgauauggcauccgacucacgcugucccacucagggugaagccuaucuggauaagcaaagugacacccaguacgugugcaaaagaacacugguggauaggggguggggaaacggcuguggccucuucgggaaggggagcuuagucacuugcgcuaaguuugccuguucuaaaaagaugaccgguaaauccauucagccugagaaucuggaauaucggaucaugcuuucaguucacggcagccagcauagugggaugauagugaacgacacaggacacgagaccgaugagaaucgcgcaaagguagaaauuacgccaaacucuccccgagcugaggccacuuugggcgguuucgggucccugggacuagacugcgaaccuagaacaggccucgauuuuagcgaccuguacuaccuuaccaugaauaacaaacacuggcuggugcauaaggagugguuccacgacaucccauugcccuggcaugcgggcgccgauacugggacaccucacuggaauaacaaggaagcacucgucgaguuuaaagacgcucacgccaagaggcaaaccgugguugugcugggaucgcaggagggugcuguccauacggccuuagcaggcgcccuggaagcugagauggauggggcgaaaggacggcucucuuccggccaccuuaagugucgucugaaaauggacaaguugcgccuaaaaggugugucauauagucugugcaccgcagccuucacauuuacuaagauuccagcugaaacccuccaugggacaguaacuguugaggugcaguacgccggcaccgauggaccguguaagguccccgcacagauggccguggacaugcaaacacugaccccugucggcagacuuaucacugcuaauccagugaucacggaaagcacagagaacuccaaaaugaugcuggaguuggaucccccuuucggggacucuuauauuguuauaggagugggugaaaagaaaaucacccaccauuggcacaggagcggcucaacuauugggaaggccuuugaggcaaccguacggggagcgaaacgaauggcuguccucggcgauacagccugggacuucgguagugugggaggcgcauuaaauucccugggaaagggcauccaccagauauucggggccgcuuuuaagagccuguucggagguaugucuugguuuucacagauucuaaucggcacccuccugauguggcuuggguugaacacuaaaaacggaaguaucagccugaugugccucgcccugggcgguguucuuauuuuccuguccacagcagugucugcu

SEQ ID NO: 9834 - RNA, 1791 nt, Artificial Sequence
  ZIKV (isolate Z1106033) ME variant CDS opt
auggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacgccaaaaacggaaguaucagccugaugugccucgcacugggcggugugcuuaucuuccuguccacugcugucucugcc

SEQ ID NO: 9835 - RNA, 1779 nt, Artificial Sequence
  ZIKV (strain MR 766) ME variant CDS opt
auggacuggaccuggauccuguuccucguggccgcugcaacaagaguccacagcgccguuacucuucccucccauucuacgaggaagcugcagacccggucacaaacaugguuggagagucgcgaauacacuaaacacuuaauuaagguggagaacuggauauuucgaaauccuggcuucgcgcugguagcuguggccaucgcauggcuacucgggagcuccaccucucagaaagucauuuaucuggugaugauccuucugauugccccagcuuacucgauccguugcauaggaguuucaaacagagauuuuguggaagguaugagcggcgggacaugggucgacgugguauuggagcauggaggcuguguuaccgugauggcacaggauaagccgacugucgacaucgaacucgugacaaccacggugaguaauauggccgaggucagguccuauugcuacgaggcuucuauuagcgauauggccuccgacucacggugucccacucagggugaagcguaucuggauaaacaaagugacacccaguacguuugcaagcgcacacugguggauagaggguggggaaacggcuguggccucuucgggaaggggagcuuaguaacuugcgcaaaauuuaccuguucuaagaaaaugacagguaaguccauccagccugagaaucuggaauauaggauuaugcuuucagugcacggcagccagcauagugggaugaucggauacgagaccgacgaggaucgggccaaagucgaagugacgccaaacucuccccgcgcugaggccacuuugggcgguuucgggucccugggacuagacugcgaaccucgaacaggccucgauuuuagcgaccuguacuaucuuaccaugaauaacaagcacuggcugguucacaaggagugguuccaugacauaccauugcccuggcacgcaggcgcugauacugggacaccucauuggaauaacaaagaagcccucguggaguuuaaggacgcgcacgccaaaagacaaaccgucgugguacugggaucgcaggagggugcaguucacacggcuuuagccggcgcucuggaagccgagauggauggggcaaagggaaggcuuuucucuggccaucucaaaugucggcugaagauggacaaauugcgucuaaaggguguguccuacucacugugcaccgccgcuuuuacauucacuaaggucccagcggaaacccuccacgggacagugacugucgaggugcaguaugcaggcaccgauggaccguguaaaauucccguucagauggccguggacaugcaaacacugaccccuguaggccgccuuaucacugcuaauccagucauuacggaaaguacagagaacagcaagaugaugcuggaguuggaucccccuuuuggggacuccuacaucgugaucggaguuggugauaaaaagauuacccaucacuggcauagaucuggcagcacuauagggaaagccuucgaagcaaccgugaggggagccaagcggauggcuguccucggcgacacagccugggauuucgguucagugggaggcguauuuaauagucugggaaagggcauccaccagauuuucggggcagcguuuaaauccuuauucggagguaugagcugguuuucucagauccugauaggcacccuacucguguggcuggggcuuaacacuaagaauggaucaauuaguuugacaugccuggcucucggcgguguuaugaucuuccugagcacggccgucuccgca

SEQ ID NO: 9836 - RNA, 1791 nt, Artificial Sequence
  ZIKV (strain NatalRGN) ME variant CDS opt
auggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacacuaaaaacggaaguaucagccugaugugccucgcccugggcggugugcuuaucuuccuguccacagcagucucugcu

SEQ ID NO: 9837 - RNA, 1809 nt, Artificial Sequence
  ZIKV (strain ZikaSPH2015) ME variant CDS opt
augggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauauuguguuggagcacgggggaugcgucaccgugauggcacaggacaagccgacaguagauaucgaacucguuaccacuacagugucuaauauggccgagguccggagcuauuguuacgaggcuuccauuucagacauggccagugauagccgcugccccacccagggcgaagcauaucuggacaaacaaucugauacgcaguacguguguaagagaacucugguggacaggggcugggggaacggaugcggucucuuuggcaagggguccuuagucaccugugcuaaauucgccugcucaaagaaaaugacaggaaagagcauccagccugagaaucuggaauaucggauaaugcuuaguguucauggcucucagcacuccgguaugauugugaacgauacugggcaugagaccgacgagaaucgcgcgaaaguagaaaucacaccaaacagcccccgagccgaggcaaccuugggaggcuuuggcucgcuggggcuagauugugaaccuagaacgggacucgacuucucugaucuguacuaccuuacuaugaauaacaagcacuggcuggugcacaaggagugguuucaugacauuccauugcccuggcacgcuggugccgacacaggcaccccucauuggaauaacaaagaagcucucgucgaguucaaggaugcccacgcaaaaaggcaaacugugguugugcuggggucccaggagggagccguccacacagcuuuagcgggcgcacuggaagccgagauggacggugcuaaggggcggcucucaaguggccaucuuaaaugccgucugaagauggauaaauugcgccuaaagggagugagcuauucccuguguaccgccgcauuuacguucaccaagaucccagccgaaacacuccacggcacuguaaccguugaggugcaguacgcugggacagacggaccgugcaaaguccccgcccagauggcaguggauaugcaaacucugaccccugucgguagacuuaucacagcgaauccagugauuaccgaaucuacugagaacagcaagaugaugcuggaguuggaucccccuuuuggcgacucauauauaguuaucggggugggagagaaaaagauuacgcaucacuggcauaggaguggcuccacaaucgguaaggcuuucgaagccaccguacggggcgcaaaacgaauggccguccucggcgacacugcuugggauuuuggaagcgugggcggggccuuaaauucucugggaaaggguauacaccagauuuucggcgcagcuuucaaaucacuguuugggggaaugaguugguucagccagauccuaaucggcacccuccugauguggcuugguuugaacacaaagaacggguccauuucucugaugugccucgcccugggcggaguucuuaucuuucugucgaccgcggugagcgcc

SEQ ID NO: 9838 - RNA, 1809 nt, Artificial Sequence
  ZIKV (isolate Z1106033) ME variant CDS opt
augggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacgccaagaacggguccaucucucugaugugccucgcgcugggcggagugcuuauuuuucugucgacagccgucagcgcu

SEQ ID NO: 9839 - RNA, 1797 nt, Artificial Sequence
  ZIKV (strain MR 766) ME variant CDS opt
augggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauaaaaguggagaacuggaucuuccgaaauccugguuuugcacugguagccguggcuauugcauggcuacucgggucuucgacaucacagaaggucaucuaucuggugaugauucuucugaucgccccagcuuacagcauacguuguaucgggguuaguaacagagacuucguggaaggaauguccggcgguacuugggucgaugugguauuggagcacgggggaugcguuaccgugauggcccaggacaaaccgacagucgauauugaacucgugaccacuacagugucuaauauggcggaggucaggagcuauuguuacgaggcauccaucucagacauggccagugauagccggugccccacccagggcgaggcuuaucuggacaagcaaucugauacgcaguacguuuguaagcgcacucugguggacagaggcugggggaacggaugcggucucuuuggcaaaggguccuuaguaaccugugccaaguucacaugcagcaaaaagaugacuggaaaaucaauucagccugaaaaucuggaauauaggaucaugcuuagugugcauggcucucagcacuccgguaugauaggguacgagaccgaugaggaccgggcaaaggucgaagugacaccaaacagcccccgcgcugaggccaccuugggaggcuuuggcucgcuggggcuagauugugaaccucgaacgggacucgacuucucugaucuguacuaucuuacuaugaauaacaagcauuggcugguucacaaagagugguuucacgacauuccauugcccuggcaugcgggugccgacacaggcaccccucacuggaauaacaaggaagcacucguggaguucaaagaugcucaugccaagagacaaacugucgugguacuggggucccaggagggagcuguucacacagccuuagcaggcgcccuggaagcugagauggacggugcgaaagggaggcucuuuucaggccaccuuaagugccggcugaaaauggauaaguugcgucuaaagggagugaguuacagccuguguaccgcagccuucacguuuaccaaagucccagcugaaacacuccauggcacugugaccgucgaggugcaguaugccgggacagacggaccgugcaagauccccguucagauggcaguggauaugcaaacucugaccccuguaggucgccuuauuacagccaauccagucaucaccgaauccacugagaacucuaaaaugaugcuggaguuggaucccccuuucggcgacagcuacaucgugauugggguuggagacaagaaaauaacgcaccauuggcacagaucaggcaguacaaucgguaaggcuuuugaagccaccgugaggggcgcaaagcggauggcgguccucggcgauacugcuugggacuucggauccgugggcgggguauucaauagccugggaaaagguauucaucagaucuuuggcgccgcauucaagucuuuauuugggggaaugucaugguucagucagauacugauuggcacccuacucguguggcugggucuuaacaccaaaaaugggagcaucuccuugacaugccuggcccucggcggaguuaugaucuuucugucuacugcugucucggcc

SEQ ID NO: 9840 - RNA, 1809 nt, Artificial Sequence
  ZIKV (strain NatalRGN) ME variant CDS opt
augggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacacaaagaacggguccaucucucugaugugccucgcccugggcggagugcuuauuuuucugucgaccgcggucagcgcc

SEQ ID NO: 9841 - RNA, 2085 nt, Artificial Sequence
  ZIKV (strain ZikaSPH2015) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9842 - RNA, 2085 nt, Artificial Sequence
  ZIKV (isolate Z1106033) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9843 - RNA, 2073 nt, Artificial Sequence
  ZIKV (strain MR 766) prME-short variant CDS opt
auggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9844 - RNA, 2085 nt, Artificial Sequence
  ZIKV (strain NatalRGN) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9845 - RNA, 2064 nt, Artificial Sequence
  ZIKV (strain ZikaSPH2015) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9846 - RNA, 2064 nt, Artificial Sequence
  ZIKV (isolate Z1106033) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9847 - RNA, 2052 nt, Artificial Sequence
  ZIKV (strain MR 766) prME-short variant CDS opt
auggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9848 - RNA, 2064 nt, Artificial Sequence
  ZIKV (strain NatalRGN) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9849 - RNA, 2082 nt, Artificial Sequence
  ZIKV (strain ZikaSPH2015) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9850 - RNA, 2082 nt, Artificial Sequence
  ZIKV (isolate Z1106033) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9851 - RNA, 2070 nt, Artificial Sequence
  ZIKV (strain MR 766) prME-short variant CDS opt
augggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9852 - RNA, 2082 nt, Artificial Sequence
  ZIKV (strain NatalRGN) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9853 - RNA, 2085 nt, Artificial Sequence
  ZIKV (strain ZikaSPH2015) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9854 - RNA, 2085 nt, Artificial Sequence
  ZIKV (isolate Z1106033) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9855 - RNA, 2073 nt, Artificial Sequence
  ZIKV (strain MR 766) prME-short variant CDS opt
auggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9856 - RNA, 2085 nt, Artificial Sequence
  ZIKV (strain NatalRGN) prME-short variant CDS opt
auggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9857 - RNA, 2064 nt, Artificial Sequence
  ZIKV (strain ZikaSPH2015) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9858 - RNA, 2064 nt, Artificial Sequence
  ZIKV (isolate Z1106033) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9859 - RNA, 2052 nt, Artificial Sequence
  ZIKV (strain MR 766) prME-short variant CDS opt
auggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9860 - RNA, 2064 nt, Artificial Sequence
  ZIKV (strain NatalRGN) prME-short variant CDS opt
auggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9861 - RNA, 2082 nt, Artificial Sequence
  ZIKV (strain ZikaSPH2015) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9862 - RNA, 2082 nt, Artificial Sequence
  ZIKV (isolate Z1106033) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9863 - RNA, 2070 nt, Artificial Sequence
  ZIKV (strain MR 766) prME-short variant CDS opt
augggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9864 - RNA, 2082 nt, Artificial Sequence
  ZIKV (strain NatalRGN) prME-short variant CDS opt
augggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgcc

SEQ ID NO: 9865 - RNA, 1785 nt, Artificial Sequence
  ZIKV (strain ZikaSPH2015) ME variant CDS opt
augaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9866 - RNA, 1785 nt, Artificial Sequence
  ZIKV (isolate Z1106033) ME variant CDS opt
augaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9867 - RNA, 1773 nt, Artificial Sequence
  ZIKV (strain MR 766) ME variant CDS opt
augaccagcaucggcaucaucggccugcugcugaccaccgccauggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9868 - RNA, 1785 nt, Artificial Sequence
  ZIKV (strain NatalRGN) ME variant CDS opt
augaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9869 - RNA, 1812 nt, Artificial Sequence
  ZIKV (strain ZikaSPH2015) ME variant CDS opt
auggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9870 - RNA, 1812 nt, Artificial Sequence
  ZIKV (isolate Z1106033) ME variant CDS opt
auggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9871 - RNA, 1800 nt, Artificial Sequence
  ZIKV (strain MR 766) ME variant CDS opt
auggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9872 - RNA, 1812 nt, Artificial Sequence
  ZIKV (strain NatalRGN) ME variant CDS opt
auggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9873 - RNA, 1791 nt, Artificial Sequence
  ZIKV (strain ZikaSPH2015) ME variant CDS opt
auggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9874 - RNA, 1791 nt, Artificial Sequence
  ZIKV (isolate Z1106033) ME variant CDS opt
auggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9875 - RNA, 1779 nt, Artificial Sequence
  ZIKV (strain MR 766) ME variant CDS opt
auggacuggaccuggauccuguuccugguggccgccgccaccagagugcacagcgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9876 - RNA, 1791 nt, Artificial Sequence
  ZIKV (strain NatalRGN) ME variant CDS opt
auggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9877 - RNA, 1809 nt, Artificial Sequence
  ZIKV (strain ZikaSPH2015) ME variant CDS opt
augggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9878 - RNA, 1809 nt, Artificial Sequence
  ZIKV (isolate Z1106033) ME variant CDS opt
augggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgcc

SEQ ID NO: 9879 - RNA, 1797 nt, Artificial Sequence
  ZIKV (strain MR 766) ME variant CDS opt
augggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgcc

SEQ ID NO: 9880 - RNA, 1809 nt, Artificial Sequence
  ZIKV (strain NatalRGN) ME variant CDS opt
augggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgcc

SEQ ID NO: 9881 - RNA, 2085 nt, Artificial Sequence
  ZIKV (strain ZikaSPH2015) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcugugggcuguucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgauuggcaaggcguucgaagccacagugcggggcgcuaaaagaauggccguccuuggagauaccgcuugggacuuuggcagcguugggggagcccucaauucccucggcaaggggauccaccaaaucuucggcgccgcuuuuaaaucucuguucggaggcaugagcugguuuucccagauucugaucgggacacuucucauguggcugggacugaacaccaagaauggcagcauuucucucaugugucuggcgcuugggggagugcugaucuuccucuccaccgccgugagcgcu

SEQ ID NO: 9882 - RNA, 2085 nt, Artificial Sequence
  ZIKV (isolate Z1106033) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcugugggcuguucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacaaucggcaaggcguucgaagccaccguccggggcgcuaaaagaauggccgugcuuggagauacagcuugggacuuuggcagcguugggggagcccucaauucccucggcaaggggauucaccaaaucuucggcgccgcuuuuaaaucucuguucggaggcaugagcugguuuucccagauccugauugggacccuucucauguggcugggacugaacgcgaagaauggcagcaucucucucaugugucuggcccuugggggagugcugauuuuccucuccaccgcugucagcgcc

SEQ ID NO: 9883 - RNA, 2073 nt, Artificial Sequence
  ZIKV (strain MR 766) prME-short variant CDS opt
auggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcugcagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcuguggacucuucgggaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgauuggcaaggccuuugaggcuacaguccgcggggccaaacggauggcggugcuuggagacaccgccugggauuucggcagcguugggggaguguuuaauucccugggcaaggggauccaccaaauuuucggcgcugccuuuaaaucucucuucggaggcaugagcugguuuucccagauccugaucgggacacugcuugucuggcucggacugaacaccaagaacggcagcauuucucugaccugucucgcucuugggggagugaugaucuuccuuuccacagccguuagcgcc

SEQ ID NO: 9884 - RNA, 2085 nt, Artificial Sequence
  ZIKV (strain NatalRGN) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcugugggcuguucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgaucggcaaggcguucgaagccacaguccggggcgcuaaaagaauggccgugcuuggagauaccgcuugggacuuuggcagcguugggggagcccucaauucccucggcaaggggauucaccaaaucuucggcgccgcuuuuaaaucucuguucggaggcaugagcugguuuucccagauccugauugggacacuucucauguggcugggacugaacaccaagaauggcagcaucucucucaugugucuggcgcuugggggagugcugauuuuccucuccaccgccgucagcgcu

SEQ ID NO: 9885 - RNA, 2064 nt, Artificial Sequence
  ZIKV (strain ZikaSPH2015) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcaccauuggcaaggccuucgaggcgacagugagaggagccaaacgcauggcugugcuuggcgacaccgccugggauuucggguccgucggaggcgcucucaauucucuggggaagggaauccaucagauuuuuggcgccgccuucaaaagccuguuugggggcauguccugguucucucaaauccugaucggaacccuucucauguggcugggccugaacacaaagaaugggagcauuucccucaugugucuggcucuuggaggcgugcugaucuuucucagcacggcgguuucugcc

SEQ ID NO: 9886 - RNA, 2064 nt, Artificial Sequence
  ZIKV (isolate Z1106033) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacaaucggcaaggccuucgaggcgaccgugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacacuucucauguggcugggccugaacgcuaagaaugggagcaucucccucaugugucuggcgcuuggaggcguucugauuuuucucagcacggccgugucugcu

SEQ ID NO: 9887 - RNA, 2052 nt, Artificial Sequence
  ZIKV (strain MR 766) prME-short variant CDS opt
auggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcaccauuggcaaggcuuucgaagccacagugcggggagcuaaaagaauggccguccuuggcgauaccgcgugggacuuuggguccgugggaggcguuuucaauucucuggggaagggaauccaucagauuuuuggcgccgcuuucaaaagccucuuugggggcauguccugguucucucaaauccugauuggaacccugcuuguguggcucggccugaacacaaagaacgggagcaucucccugacgugucucgcccugggaggcgucaugaucuuucuuagcaccgcugugucugcc

SEQ ID NO: 9888 - RNA, 2064 nt, Artificial Sequence
  ZIKV (strain NatalRGN) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcaccaucggcaaggccuucgaggcgacagugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacccuucucauguggcugggccugaacacaaagaaugggagcaucucccucaugugucuggcucuuggaggcguucugauuuuucucagcacggcggugucugcc

SEQ ID NO: 9889 - RNA, 2082 nt, Artificial Sequence
  ZIKV (strain ZikaSPH2015) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgaucgggaaggcuuuugaggccacagugagaggagcuaagcgcauggccgugcuuggcgauaccgccugggacuucgggagcgucggaggcgcucucaauucccuggggaaaggcauucaccagaucuucggagcggccuuuaagucucuguucggcgggaugagcugguuuucccaaauccugauuggaacacuucucauguggcugggccugaacaccaaaaaugggagcaucucucucaugugccuggcucuuggaggcgugcugauuuuccucuccaccgccguuagcgcc

SEQ ID NO: 9890 - RNA, 2082 nt, Artificial Sequence
  ZIKV (isolate Z1106033) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacaauugggaaggcuuuugaggccaccgugagaggagcuaagcgcauggccguccuuggcgauacagccugggacuucgggagcgugggaggcgcucucaauucccuggggaaaggcauccaccagauuuucggagcggccuuuaagucucuguucggcgggaugagcugguuuucccaaauccugaucggaacccuucucauguggcugggccugaacgcuaaaaaugggagcauuucucucaugugccuggcccuuggaggcguucugaucuuccucuccaccgccgugagcgcu

SEQ ID NO: 9891 - RNA, 2070 nt, Artificial Sequence
  ZIKV (strain MR 766) prME-short variant CDS opt
augggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgaucgggaaagccuucgaagcgacagugcggggagccaagagaauggcuguccuuggcgacaccgccugggauuucgggagcgugggaggcguuuuuaauucccuggggaaaggcauucaccagaucuucggagcugccuuuaagucucucuucggcgggaugagcugguuuucccaaauucugaucggaacacugcuuguguggcucggccugaacaccaagaacgggagcaucucucugaccugccucgcccugggaggcgucaugauuuuccuuuccacagcugugagcgcg

SEQ ID NO: 9892 - RNA, 2082 nt, Artificial Sequence
  ZIKV (strain NatalRGN) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgauugggaaggcuuuugaggccacagugagaggagcuaagcgcauggccguccuuggcgauaccgccugggacuucgggagcgugggaggcgcucucaauucccuggggaaaggcauccaccagauuuucggagcggccuuuaagucucuguucggcgggaugagcugguuuucccaaauccugaucggaacacuucucauguggcugggccugaacaccaaaaaugggagcauuucucucaugugccuggcucuuggaggcguucugaucuuccucuccaccgccgugagcgcc

SEQ ID NO: 9893 - RNA, 2085 nt, Artificial Sequence
  ZIKV (strain ZikaSPH2015) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcuguggccucuucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgcuuggcaaggcguucagcacaacccugaaaggggcccaacggcucgcugcccugggagauacagcuugggacuuuggcuccauugggggaguguucaauucuaucggcagagccguccaccagguguuugggggcgccuuccgcacccuguuuggaggcaugagcuggaucacccaggggcuuaugggagcucuccugcuguggaugggcguuaacgcgcgggauagauccauugcccucgcuuuccuggccacagggggagugcuugucuuucuggccacgaaugugcaugcu

SEQ ID NO: 9894 - RNA, 2085 nt, Artificial Sequence
  ZIKV (isolate Z1106033) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcuguggccucuucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacacuuggcaaggcguucagcaccacacugaaaggggcccaacggcucgcugcccugggagauaccgcuugggacuuuggcuccaucgggggagucuucaauucuauuggcagagccgugcaccagguuuuugggggcgccuuccgcacccuguuuggaggcaugagcuggaucacacaggggcuuaugggagcucuccugcuguggaugggcgugaacgcgcgggauagauccaucgcccucgcuuuccuggccaccgggggaguccuuguguuucuggccacgaauguucaugcu

SEQ ID NO: 9895 - RNA, 2073 nt, Artificial Sequence
  ZIKV (strain MR 766) prME-short variant CDS opt
auggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcuccagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcugugggcuuuucggaaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgcuuggcaaggccuuuagcacaacccugaaaggggcucaacgccucgccgcgcugggagacacagccugggauuucggcuccauugggggagucuuuaauucuaucggccgggcugugcaccagguuuucgggggcgccuuuagaacccuguucggaggcaugagcuggauuacccaggggcuuaugggagcucuccugcuguggaugggcgugaacgcccgcgaccgguccaucgcccucgcuuuucuggcgacagggggaguccuuguguuccuggccacgaacguucaugcu

SEQ ID NO: 9896 - RNA, 2085 nt, Artificial Sequence
  ZIKV (strain NatalRGN) prME-short variant CDS opt
auggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcuguggccucuucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgcuuggcaaggcguucagcacaacccugaaaggggcccaacggcucgcugcccugggagauacagcuugggacuuuggcuccaucgggggagucuucaauucuauuggcagagccgugcaccagguuuuugggggcgccuuccgcacccuguuuggaggcaugagcuggaucacccaggggcuuaugggagcucuccugcuguggaugggcgugaacgcgcgggauagauccaucgcccucgcuuuccuggccacagggggaguccuuguguuucuggccacgaauguucaugcu

SEQ ID NO: 9897 - RNA, 2064 nt, Artificial Sequence
  ZIKV (strain ZikaSPH2015) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcacccuuggcaaggccuucuccacaacccugaaaggagcgcagagacucgccgcucugggcgacaccgccugggauuucgggucuauuggaggcguguuuaauagcaucgggcgcgcugugcaucaagucuucggaggcgccuuucggacacuguucgggggcauguccuggauuacgcagggacuuaugggcgcccuccugcuguggaugggggugaacgcuagagaccgcucuaucgcgcucgccuuucuggcuaccggaggcguucuuguguuccuggccacaaauguccacgcc

SEQ ID NO: 9898 - RNA, 2064 nt, Artificial Sequence
  ZIKV (isolate Z1106033) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacacuuggcaaggccuucuccaccacccugaaaggagcgcagagacucgccgcucugggcgacacagccugggauuucgggucuaucggaggcguguuuaauagcauugggcgcgcuguccaucaaguguucggaggcgccuuucggacgcuguucgggggcauguccuggaucacccagggacuuaugggcgcccuccugcuguggauggggguuaacgcuagagaccgcucuauugcgcucgccuuucuggcuacaggaggcgugcuugucuuccuggccaccaaugugcacgcc

SEQ ID NO: 9899 - RNA, 2052 nt, Artificial Sequence
  ZIKV (strain MR 766) prME-short variant CDS opt
auggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcacccuuggcaaggcuuucuccacaacccugaaaggagcccagcggcucgcugcccugggcgauaccgcgugggacuuugggucuauuggaggcguguucaauagcaucgggagagccguccaucaaguguuuggaggcgcuuuccgcacacuguuugggggcauguccuggauuacgcagggacuuaugggcgcccuccugcuguggauggggguuaacgcucgggauagaucuaucgcccucgccuuccuggcuaccggaggcgugcuugucuuucuggcgacaaacgugcacgcc

SEQ ID NO: 9900 - RNA, 2064 nt, Artificial Sequence
  ZIKV (strain NatalRGN) prME-short variant CDS opt
auggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcacccuuggcaaggccuucuccacaacccugaaaggagcgcagagacucgccgcucugggcgacaccgccugggauuucgggucuaucggaggcguguuuaauagcauugggcgcgcuguccaucaaguguucggaggcgccuuucggacacuguucgggggcauguccuggaucacgcagggacuuaugggcgcccuccugcuguggauggggguuaacgcuagagaccgcucuauugcgcucgccuuucuggcuaccggaggcgugcuugucuuccuggccacaaaugugcacgcc

SEQ ID NO: 9901 - RNA, 2082 nt, Artificial Sequence
  ZIKV (strain ZikaSPH2015) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgcuugggaaggcuuuuagcacaacccugaagggagcccagagacucgcugcccugggcgauacagccugggacuucggguccaucggaggcguguucaauucuauugggcgcgcugugcaccaagucuuuggcggagcguuccggacccuguuuggcgggaugagcuggaucacccagggacuuaugggcgcccuccugcuguggaugggggugaacgcuagagaucgcuccaucgcccucgccuuccuggcuacaggaggcguucuuguguuucuggccacgaauguccaugcg

SEQ ID NO: 9902 - RNA, 2082 nt, Artificial Sequence
  ZIKV (isolate Z1106033) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacacuugggaaggcuuuuagcaccacacugaagggagcccagagacucgcugcccugggcgauaccgccugggacuucggguccauuggaggcguguucaauucuaucgggcgcgcuguccaccaaguguuuggcggagcguuccggacccuguuuggcgggaugagcuggauuacacagggacuuaugggcgcccuccugcuguggauggggguuaacgcuagagaucgcuccaucgcccucgccuuccuggcuacgggaggcgugcuugucuuucuggccaccaaugugcaugcg

SEQ ID NO: 9903 - RNA, 2070 nt, Artificial Sequence
  ZIKV (strain MR 766) prME-short variant CDS opt
augggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgcuugggaaagccuucagcacaacccugaagggagcgcagcggcucgccgcucugggcgacacagccugggauuucggguccaucggaggcguguuuaauucuauugggagagcuguccaccaaguguucggcggagccuuucgcacccuguucggcgggaugagcuggaucacccagggacuuaugggcgcccuccugcuguggauggggguuaacgcucgggacagauccauugcgcucgccuuucuggcuacaggaggcgugcuugucuuccuggccacgaacgugcaugcc

SEQ ID NO: 9904 - RNA, 2082 nt, Artificial Sequence
  ZIKV (strain NatalRGN) prME-short variant CDS opt
augggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgcuugggaaggcuuuuagcacaacccugaagggagcccagagacucgcugcccugggcgauacagccugggacuucggguccauuggaggcguguucaauucuaucgggcgcgcuguccaccaaguguuuggcggagcguuccggacccuguuuggcgggaugagcuggauuacccagggacuuaugggcgcccuccugcuguggauggggguuaacgcuagagaucgcuccaucgcccucgccuuccuggcuacaggaggcgugcuugucuuucuggccacgaaugugcaugcg

SEQ ID NO: 9905 - RNA, 1785 nt, Artificial Sequence
  ZIKV (strain ZikaSPH2015) ME variant CDS opt
augaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggauaucguccuggagcacggaggcugugugacgguuauggcgcaggacaaacccaccguggauauugaacuugucacaaccacagugagcaauauggccgaggugcggucuuauugcuacgaggcuuccaucagcgacauggccucugauucccgcuguccuacccagggcgaggcuuaucuggacaagcaaagcgauacgcaguacgucugcaaaagaacacucguugaccggggguggggaaacggcugugggcuguuuggaaagggcucucuugugaccugcgccaaguucgcguguuccaaaaagaugacagggaaaagcauucagcccgaaaaucuggaauaucgcaucaugcucuccgugcauggaucucagcacagcggcaugauugucaacgauaccggccaugagaccgacgagaauagagccaagguggaaaucacaccuaacagcccccgggcugaggccacgcuugggggauuuggcucccuggggcucgauugcgaaccucgcaccggacuggacuucucugaucuuuacuaccugacaaugaauaacaaacacuggcucguucacaaggagugguuucaugacaucccgcugcccuggcacgcuggcgccgacaccgggacaccucauuggaauaacaaggaagcccuuguggaguucaaagaugcucacgcgaagagacaaaccgucgugguucugggaucccaggagggcgccgugcacacggcucucgccggcgcccuggaagcugagauggacggggccaaaggacggcugagcucuggccaucucaagugucgccugaaaauggauaagcugagacugaaaggggucagcuauucccucugcacagcggcuuuuaccuucaccaagauucccgccgaaacacugcacggaaccgugacagucgaggugcaguacgccggcacggacgggccuuguaagguucccgcucagauggccguggauaugcaaacccuuacaccggucggccggcugaucaccgcuaauccugugauuacagaaucuaccgagaacagcaaaaugaugcucgagcuggaucccccuuuuggagacuccuauaucguuauuggcgugggggaaaagaaaaucacgcaucacuggcauagaagcggaucuaccaucggcaaggccuucgaggcgacaguccgcggggccaaacggauggcugugcugggagacaccgccugggauuuuggcuccguugggggcgcucucaauagccugggaaagggcauucaccagaucuucggggccgcguucaagucucuuuuuggaggcauguccugguucagccagauucugaucgggacacuccugauguggcugggacuuaacaccaaaaacggcuccauuucucucaugugccuggcccucgggggcgugcugaucuuucugagcacggcugucuccgcc

SEQ ID NO: 9906 - RNA, 1785 nt, Artificial Sequence
  ZIKV (isolate Z1106033) ME variant CDS opt
augaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacgccaaaaacggcuccaucucucucaugugccuggcucucgggggcguccugauuuuucugagcaccgccguguccgcu

SEQ ID NO: 9907 - RNA, 1773 nt, Artificial Sequence
  ZIKV (strain MR 766) ME variant CDS opt
augaccagcaucggcauuaucgggcugcugcugacaacggccauggcugccgugacccuucccucccacucuacaagaaagcugcagacccggagccaaacauggcucgagucccgcgaauacaccaaacaucugauuaaggucgagaacuggaucuucagaaauccuggauuugcgcuuguugcuguggccauugccuggcugcucggcucuagcacaucccagaaagugaucuaucuggucaugauccugcucauugcuccggccuacucuauccggugcauuggggugagcaaccgcgacuucguugaaggaauguccggcgggaccuggguggaugucgugcuggagcacggaggcuguguuacggugauggcucaggacaagcccaccgucgauaucgaacuugugacaaccacagugagcaauauggccgaggucagaucuuauugcuacgaggcguccauuagcgacauggccucugauucccgguguccuacccagggcgaggcuuaucuggacaaacaaagcgauacgcaguacguuugcaagcgcacacucguggacagaggguggggaaacggcugugggcuguuuggaaagggcucucuugugaccugcgccaaauucacauguuccaagaaaaugaccggaaagagcauccagcccgaaaaucuggaauaucggauuaugcucuccguccaugggucucagcacagcggcaugaucggcuacgagaccgaugaggaccgcgcuaaaguggaaguuacaccuaacucccccagagccgaggcgacgcucgggggauuuggcagccuggggcuggauugcgaaccucggaccggacuggacuucucugaucuuuacuaucugacaaugaauaacaagcauuggcucgugcacaaggagugguuucacgacaucccgcugcccuggcaugccggcgcugacaccgggacaccucacuggaauaacaaagaagcccuugucgaguucaaggaugcucaugccaaacgccaaaccgugguugugcugggaucccaggagggcgccguccacacggcucucgcgggcgcccuggaagcugagauggacggggccaagggaagacuguuuagcggccaccucaaaugucggcugaagauggauaaacuucgccugaagggggugucuuacagccucugcacagccgcuuucaccuuuaccaagguccccgccgaaacacugcauggaaccgugacaguugaggugcaguaugcgggcacggacgggccuuguaaaauucccguccagauggcuguggauaugcaaacccuuacaccgguuggcagacugaucaccgccaauccugugauuacagaauccaccgagaacucuaagaugaugcucgagcuggaucccccuuucggagacagcuacaucgucauuggcgugggggacaaaaagaucacgcaccauuggcaccgguccggaagcaccaucggcaaagccuuugaagcuacagugagaggggccaagcgcauggcuguucugggagauaccgccugggacuucggcucugucgggggcguguucaauucccucggaaagggcauucaucagaucuuuggggcggccuucaaaagccuguuuggaggcaugucuugguucucccagauucuuaucgggacacugcucguguggcugggacugaacaccaagaauggcagcauuucccuuacgugccucgcucucgggggcgucaugaucuuucugucuacagccgugagcgcu

SEQ ID NO: 9908 - RNA, 1785 nt, Artificial Sequence
  ZIKV (strain NatalRGN) ME variant CDS opt
augaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacaccaaaaacggcuccaucucucucaugugccuggcccucgggggcguccugauuuuucugagcacggcuguguccgcc

SEQ ID NO: 9909 - RNA, 1812 nt, Artificial Sequence
  ZIKV (strain ZikaSPH2015) ME variant CDS opt
auggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgauaucgugcucgaacacggaggcuguguuaccgugauggcucaggacaaaccuacagucgauauugagcuggugaccacgaccguguccaauauggccgagguccggagcuauugcuacgaggcuucuaucuccgacauggccagcgauucucgcugucccacacaaggcgaagcguaucuugacaagcaguccgauacccaguacguuugcaaaagaacacugguggaccggggguggggaaacggcugugggcucuuuggaaagggcagccuggugaccugcgccaaguucgcuuguuccaaaaagaugacggggaaaucuauucagccugaaaaucuugaguaucgcaucaugcugagcguccauggaucccaacacagcggcaugaucgugaacgauacaggccaugagaccgacgaaaauagagccaagguugagauuacacccaacucuccucgggcugaagccacccucgggggauuuggcucccuggggcuggauugcgagccgcgcaccggacucgacuucagcgaucuguacuaccuuacaaugaauaacaaacacuggcuggugcacaaggaaugguuucaugacaucccccucccuuggcacgccggcgcugacacggggacaccccauuggaauaacaaggaggcgcuggucgaguucaaagaugcccacgcuaagagacagacagugguugugcuuggaucucaggaaggcgccguccacaccgcccuggcuggcgcccucgaggcggaaauggacggggcuaaaggacggcugagcuccggccaucugaagugucgccucaaaauggauaagcugagacuuaaaggggugucuuauagccugugcacagccgccuuuaccuucacgaagauuccugcugagacacuccacggaaccgucaccguggaaguucaguacgccggcacagacgggcccuguaaggugccggcucaaauggccgucgauaugcagacccugacaccugugggccggcuuaucacggcgaaucccguuauuaccgaguccacagagaacagcaaaaugaugcuggaacucgacccucccuuuggagauucuuauaucgugaucggcgucggggagaagaaaauuacccaucacuggcauagauccggaagcacaaucggcaaggccuucgaagcuaccgugcgcggggccaaacggauggcugugcugggagacacggccugggauuucggcucuguugggggcgcgcuuaauucccucggaaagggcauucaccagaucuuuggggccgcuuucaagagccuguuuggaggcauguccugguucucucaaauucuuaucgggacccugcucauguggcugggacugaacaccaaaaacggcagcaucucccuuaugugccucgcccucgggggcguccugauuuuucugucuaccgcugugagcgcc

SEQ ID NO: 9910 - RNA, 1812 nt, Artificial Sequence
  ZIKV (isolate Z1106033) ME variant CDS opt
auggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagaccguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacgccaaaaacggcagcaucucccuuaugugccucgcucucgggggcgugcugaucuuucugucuacagccgugagcgcc

SEQ ID NO: 9911 - RNA, 1800 nt, Artificial Sequence
  ZIKV (strain MR 766) ME variant CDS opt
auggccaucagcggcgugcccguccugggguucuuuauuaucgcuguucucauguccgcccaggagucuugggcggcugugacccugccuagccacuccacaagaaaacuucaaacgcggucucagaccuggcuggaaagccgcgaguacacaaagcaucucauuaagguggaaaacuggaucuucagaaauccgggauuugcccuggucgccguggcuauugccuggcuucugggcuccucuaccagccagaaaguuaucuaucucgugaugauccugcugauugcucccgccuacuccauccggugcauuggggucagcaaccgcgacuucguggagggaaugucuggcgggacauggguugaugugguccucgaacacggaggcugugugaccgugauggcgcaggacaagccuacagucgauaucgagcugguuaccacgaccguguccaauauggccgaggugagaagcuauugcuacgaagccucuauuuccgacauggcuagcgauucucggugucccacacaaggcgaggcuuaucuugacaaacaguccgauacccaguacgucugcaagcgcacacugguggacagaggguggggaaacggcugugggcucuuuggaaagggcagccugguuaccugcgccaaauucacguguuccaagaaaaugacagggaagucuauccagccugaaaaucuugaguaucggauuaugcugagcgugcauggaucccaacacagcggcaugaucggcuacgagaccgaugaagaccgcgcgaaagucgaggugacacccaacucuccuagagccgaagcuacccucgggggauuuggcucccuggggcuggauugcgagccgcggaccggacucgacuucagcgaucuguacuaucuuacaaugaauaacaagcauuggcugguucacaaggaaugguuucacgacaucccccucccuuggcaugccggcgcugacacggggacaccccacuggaauaacaaagaggcccugguggaguucaaggaugcccaugcuaaacgccagaccgucgugguccuuggaucucaggaaggcgcggugcacaccgcccuggcuggcgcccucgaggccgaaauggacggggcuaagggaagacuguuuagcggccaccugaaaugucggcucaagauggauaaacugcgccuuaaggggguuuccuacucucugugcacagccgcguucaccuuuacgaaggugccugcugagacacuccauggaaccgucaccguggaaguucaguaugccggcacagacgggcccuguaaaauuccggugcaaauggccgucgauaugcagacccugacaccugugggcagacuuaucacggcuaaucccgugauuaccgagagcacagagaacuccaagaugaugcuggaacucgacccucccuucggagauagcuacaucguuauuggcgucggggacaaaaagaucacccaccauuggcaccggucuggauccacaaucggcaaagccuucgaggcuaccgugagaggggccaagcgcauggcggugcugggagauacggccugggacuuuggcagcgucgggggcguguucaauucucugggaaagggcauucaucagaucuuuggggcugccuucaaaucccucuuuggaggcaugagcugguucucccaaauucugaucgggacccuucugguuuggcucggacugaacacaaagaauggcucuauuagccugaccugccuugcucucgggggcgugaugaucuuucuguccacagccgucucugcg

SEQ ID NO: 9912 - RNA, 1812 nt, Artificial Sequence
  ZIKV (strain NatalRGN) ME variant CDS opt
auggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagacaguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacaccaaaaacggcagcaucucccuuaugugccucgcccucgggggcgugcugaucuuucugucuaccgcugugagcgcc

SEQ ID NO: 9913 - RNA, 1791 nt, Artificial Sequence
  ZIKV (strain ZikaSPH2015) ME variant CDS opt
auggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacaucguccucgagcauggcgggugugugaccguuauggcccaggauaaacccacgguggacauugaacuggucaccacaaccgugagcaauauggcugaggugcgcucuuauugcuacgaggccuccaucagcgauauggcuucugacuccagauguccuacacagggagaagccuaucuugauaagcaaagcgacacccaguacgucugcaaacggacgcugguugaucgcggcuggggcaacggguguggacucuucggcaaggggucucuggugacaugcgcgaaguuugccuguuccaaaaagaugaccggaaaaagcauucagcccgagaaucuugaauauagaaucaugcuguccgugcacggcucucagcauagcgggaugauugucaacgacacaggacacgagaccgaugagaaucgggcuaagguggaaaucaccccuaacagcccccgcgccgaggcuacacucggcggcuucgggucccugggacuggacugcgaaccuagaacgggccucgauuuuucugaccuguacuaccuuaccaugaauaacaaacacuggcugguucauaaggagugguuccacgacaucccgcuccccuggcaugccggggccgauacaggaaccccucacuggaauaacaaggaagcucugguggaguuuaaagacgcgcacgccaagcggcaaacagucgugguucuuggcucccaggagggggcugugcauaccgcccuggccggagcucucgaagccgagauggauggcgcgaaaggccgccugagcucugggcaccugaaguguagacucaaaauggacaagcugcggcuuaaaggagucagcuauucccugugcacggcugccuucacauuuaccaagauucccgccgaaacccuccauggcacagugaccgucgaggugcaguacgcugggacagauggaccuuguaagguucccgcccagauggcuguggacaugcaaacgcugaccccggucggcagacuuaucacagccaauccugugauuaccgaaucuacagagaacagcaaaaugaugcuggagcucgaucccccuuucggggacuccuauaucguuauuggcgugggagaaaagaaaaucacccaccauuggcaccgcagcggcucuacgaucgggaaggcguuugaggccaccguccggggagcuaaaagaauggccgugcugggcgauacagcuugggacuucggguccgugggaggcgcccugaauagccucgggaagggcauucaccagaucuucggagcggccuuuaagucucuguucggcgggauguccugguuuagccagauucuuaucggaacccugcucauguggcugggccugaacacaaagaacggguccauuucucuuaugugccucgcucugggaggcguucugaucuuccucagcaccgccgucuccgcu

SEQ ID NO: 9914 - RNA, 1791 nt, Artificial Sequence
  ZIKV (isolate Z1106033) ME variant CDS opt
auggacuggaccuggauccuguuccucguggccgcugccacaagaguccacagcgcgguuacgcugcccucccauucuacccggaaacuucagacacgcagccaaaccuggcuggaguccagagaauacacaaagcaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacgcuaaaaacggguccaucucucuuaugugccucgcccugggaggcguccugauuuuccucagcacagcuguguccgcc

SEQ ID NO: 9915 - RNA, 1779 nt, Artificial Sequence
  ZIKV (strain MR 766) ME variant CDS opt
auggacuggaccuggauccuguuccucguggccgcugccacaagaguccacagcgcgguuacgcugcccucccauucuacccggaaacuucagacacgcagccaaaccuggcuggaguccagagaauacacaaaacaccucauuaagguggagaacuggaucuuucggaauccuggcuucgcucugguggccgucgccauugcuuggcuucuggggucuagcaccucccagaaagugaucuaucucguuaugauucugcugaucgccccggcuuacucuauccgcugcauuggagugagcaacagagauuuugucgaaggcauguccgggggaacauggguggacguugugcucgagcauggcgggugugucaccgugauggcccaggauaagcccacgguggacaucgaacuggucaccacaaccguuagcaauauggcggaggugcggucuuauugcuacgaggccuccauuagcgauauggcuucugacucccgcuguccuacacagggagaagccuaucuugauaaacaaagcgacacccaguacgugugcaagagaacgcuggucgaucggggcuggggcaacggguguggacucuucggcaaggggucucuggugacaugcgcuaaauuuaccuguuccaagaaaaugacaggaaagagcauccagcccgagaaucuugaauaucgcauuaugcuguccguucacggcucucagcauagcgggaugaucggauacgagaccgacgaggauagagccaaaguggaagucaccccuaacagcccccgggcggaggccacacucggcggcuucgggucccugggacuggacugcgaaccucgcacgggccucgauuuuucugaccuguacuaucuuaccaugaauaacaagcacuggcuggugcacaaggagugguuccaugacauuccgcuccccuggcacgcuggggccgauacaggaaccccucauuggaauaacaaagaagcucugguugaguuuaaggacgcccacgccaaaagacaaacaguggucgugcuuggcucccaggagggggcuguccacaccgcgcuggccggagcucucgaagccgagauggauggcgccaagggccggcuguucagcgggcaucugaaaugucgccucaagauggacaaacugagacuuaagggagugucuuacagccugugcacggcugccuuuacauucaccaagguucccgcggaaacccuccacggcacagugaccgucgaggugcaguaugcugggacagauggaccuuguaaaauccccguucagauggccguggacaugcaaacgcugaccccggucggccggcuuaucacagccaauccugugauuaccgaauccacagagaacucuaagaugaugcuggagcucgaucccccuuuuggggacagcuacaucgugauuggcguuggagauaaaaagaucacccaucacuggcauagauccggcagcacgauugggaaggcuuucgaagccaccguccgcggagcuaagcggauggccgugcugggcgacacagcgugggauuucgggucugugggaggcgucuuuaauucccuggggaagggcauccaccagaucuucggagccgcuuuuaaaagccucuucggcgggaugucuugguuuucccagauucugaucggaacccuucugguguggcucggccugaacacaaagaaugggagcauuucccugaccugccuugcccucggaggcguuaugaucuuccugucuacggcugugagcgcc

SEQ ID NO: 9916 - RNA, 1791 nt, Artificial Sequence
  ZIKV (strain NatalRGN) ME variant CDS opt
auggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacacaaagaacggguccaucucucuuaugugccucgcucugggaggcguccugauuuuccucagcaccgccguguccgcu

SEQ ID NO: 9917 - RNA, 1809 nt, Artificial Sequence
  ZIKV (strain ZikaSPH2015) ME variant CDS opt
augggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggauauuguccucgagcacggcggcugcgugaccguuauggcucaggacaagcccacaguggauaucgaacuggucaccacgaccguguccaauauggccgaggugcgcagcuauuguuacgaggcgucuauuuccgacauggccagcgauucuagaugcccuacacagggggaggcuuaucuugacaaacaauccgauacccaguacgucuguaagcggacacugguugaccgcggauggggcaacgggugcggacucuuuggcaaggggagccuggugaccugugccaaauucgcuugcuccaagaaaaugacgggaaagucuauccagcccgaaaaucuugaauauagaauuaugcugagcgugcauggcucccagcacagcggcaugaucgucaacgauacagggcaugagaccgacgagaaucgggccaaaguggaaaucacaccuaacucuccccgcgccgaggcuacccucggaggcuuugggucccugggacuggauugugaaccuagaaccggccucgacuucagcgaucuguacuaccuuacaaugaauaacaagcacuggcugguucacaaggagugguuucaugacauuccgcuccccuggcacgcgggggccgacacgggaaccccucauuggaauaacaaagaagcucugguggaguucaaggaugcccacgccaaacggcaaacagucgugguucuuggcucucaggagggcgcugugcacaccgcccuggcgggggcucucgaagccgagauggacggagccaagggccgccugagcuccgggcaucugaaaugcagacucaagauggauaaacugcggcuuaagggagucucuuauagccuguguacagcugccuuuaccuucacgaagauccccgcugaaacacuccacggcaccgugaccgucgaggugcaguacgccgggacagacggcccuugcaaaguucccgcgcagauggccguggauaugcaaacccugacaccggucggaagacuuauuacggcuaauccugugaucaccgaauccacagagaacagcaagaugaugcuggagcucgaucccccuuuuggcgacucuuauauuguuaucggggugggagagaaaaagaucacccaucacuggcaucgcuccggcagcacaauugggaaagccuucgaagcuaccguccggggagccaagagaauggcggugcugggcgacacggccugggauuuugggucugugggcggagcucucaauucccugggcaaggggauccaccagauuuucggagccgcuuucaaaagccuguuuggcgggauguccugguucucucagauccuuauuggaacccugcucauguggcugggccugaacacaaagaacgggagcaucucccuuaugugccucgcccugggcggaguucugaucuuucucucuaccgccgucagcgcu

SEQ ID NO: 9918 - RNA, 1809 nt, Artificial Sequence
  ZIKV (isolate Z1106033) ME variant CDS opt
augggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacgccaagaacgggagcauuucccuuaugugccucgcccugggcggaguccugaucuuucucucuacagcugugagcgcg

SEQ ID NO: 9919 - RNA, 1797 nt, Artificial Sequence
  ZIKV (strain MR 766) ME variant CDS opt
augggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucaucaaaguggagaacuggauuuuccggaauccuggcuuugcucugguggccgucgcuaucgccuggcuucugggguccucuaccagccagaaggugauuuaucucguuaugauccugcugaucgcgccggccuacuccauucgcuguaucggagugagcaacagagacuucgucgaaggcaugucugggggaacauggguggauguugugcucgagcacggcggcugcgucaccgugauggcucaggacaaacccacaguggauauugaacuggucaccacgaccguuuccaauauggccgaggugcggagcuauuguuacgaggcuucuaucuccgacauggccagcgauucucgcugcccuacacagggggaagcguaucuugacaagcaauccgauacccaguacguguguaagagaacacuggucgaccggggauggggcaacgggugcggacucuuuggcaaagggagccuggugaccugugccaaguucacgugcuccaaaaagaugacaggaaaaucuauucagcccgagaaucuugaauaucgcaucaugcugagcguucauggcucccagcacagcggcaugauuggguacgagaccgaugaggacagagcuaagguggaagucacaccuaacucuccccgggccgaggcuacccucggaggcuuugggucccugggacuggauugugaaccucgcaccggccucgacuucagcgaucuguacuaucuuacaaugaauaacaagcauuggcuggugcacaaagagugguuucacgacaucccgcuccccuggcaugccggggccgacacgggaaccccucacuggaauaacaaggaagcucugguugaguucaaagaugcgcaugccaagagacaaacaguggucgugcuuggcucucaggagggcgcuguccacaccgcccuggccggggcucucgaagccgagauggacggagcgaaaggccggcuguuuagcgggcaccugaagugccgccucaaaauggauaagcugagacuuaagggaguguccuacucucuguguacagcugccuucaccuuuacgaaaguucccgccgaaacacuccauggcaccgugaccgucgaggugcaguaugcugggacagacggcccuugcaagauccccguucagauggccguggauaugcaaacccugacaccggucggacggcuuauuacggcuaauccugugaucaccgaaagcacagagaacuccaaaaugaugcuggagcucgaucccccuuucggcgacagcuacauugugaucgggguuggagacaagaaaauuacccaccauuggcacagaucuggcuccacaaucgggaaggccuuugaagcgaccguccgcggagccaagcggauggcugugcugggcgauacggccugggacuucgggagcgugggcggagucuucaauucucugggcaaagggauccaucagauuuuuggagcugccuucaagucccucuuuggcgggaugagcugguucucccagauccugauuggaacccuucugguguggcucggccugaacaccaaaaaugggucuaucagccugacaugccuugcgcucggcggaguuaugauuuuucuguccacagccgugucugcu

SEQ ID NO: 9920 - RNA, 1809 nt, Artificial Sequence
  ZIKV (strain NatalRGN) ME variant CDS opt
augggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacacaaagaacgggagcauuucccuuaugugccucgcccugggcggaguccugaucuuucucucuaccgccgugagcgcu

SEQ ID NO: 9921 - RNA, 2085 nt, Artificial Sequence
  ZIKV (strain ZikaSPH2015) prME-short variant CDS opt
auggcaauaagcggaguaccaguuuuagguuucuuuauaauagcugucuuaaugucagcacaggaaucaugggcaguaacuagaagagggucagccuauuauauguaccuagauagaaaugacgcuggugaagcgauaaguuuuccaaccacuuuaggcaugaauaaaugcuauauacaaauaauggaccuuggacauaugugcgaugcuacaaugucauacgaaugcccaauguuagaugaagguguagaaccagaugacguagauugcugguguaauacaacgaguacauggguaguauauggaacuugccaucauaagaaaggagaagcaagaagaucaaggagagcaguuacauuaccaucucauucuacuagaaaacuacaaaccagaucucaaacuugguuagaaaguagagaauacacaaaacaucuaauaagaguagaaaauuggaucuuuagaaauccaggauuugcauuagcagcagcagcaauagcauggcuauuaggaagcucaacaagucaaaaaguaauauacuuaguaaugauacuucuaauagcaccagcauauucaauaagauguauagguguaucaaauagagauuuugucgaaggaaugucaggugguacauggguagauauagucuuagaacacggaggaugugucacaguuauggcucaagauaaaccaacaguagauauugagcuaguaacaacgacaguaucaaacauggccgaagucagaucauacuguuaugaagcaucaauaagcgacauggcaagugauaguagauguccgacacaaggagaagcauaucuagacaaacaaucagauacacaguauguaugcaaaagaacauuaguagauagaggcuggggaaacgguugcggauuauuugguaaaggcagccucguaacaugcgcaaaauuugcaugcucgaagaaaaugacagguaaaaguauacaaccagaaaaccuagaauacagaaucauguuaaguguucaugguagucaacauaguggaaugauaguuaacgauacaggacacgaaacugaugaaaauagagcaaaaguagaaauaacaccuaauucuccaagagcagaagcaacacuagggggauuugguucauuaggauuagacugugaaccaagaacagguuuagauuuuucagauuuauauuaccucacaaugaauaacaaacauugguuaguacauaaagaaugguuucaugauauuccauugccuuggcaugccggugcagacacaggcacaccacauuggaauaauaaggaagcacuuguggaauuuaaagaugcacaugcaaaaagacaaacaguuguaguacucgguucacaagaaggagcaguacacaccgcauuagcaggcgcacucgaggcagaaauggauggggcaaaagggagacuaaguaguggacaucugaaaugcagauuaaaaauggacaaacuacgacuaaaaggaguaucauauagucuuugcacagccgcguucacguucacuaaaauaccugcugaaacauuacacggaacgguaacuguagaaguacaauaugcaggaacagauggaccaugcaaaguuccugcgcaaauggcagucgacaugcaaacauuaacaccaguagggagguuaauuacagcuaauccaguuauaacagaaaguacagagaauaguaaaaugaugcuagaauuagauccaccuuuuggggacucuuacauaguaauaggaguaggagaaaagaaaauaacccaucauuggcaucgaaguggaaguacaauaggaaaagcauuugaggcaacaguaagaggagcaaaaagaauggcaguacuuggagauacagccugggacuucggcagugucggaggagcacuaaauaguuuaggaaaagguauacaucaaauuuuuggagccgccuuuaaaucauuauucggagggauguccugguuuagucaaauauuaauuggcacauuauuaauguggcuaggauuaaauaccaaaaauggcucaauaucauuaauguguuuagcguuagguggaguacuaaucuuuuugagcacggcagucagugcc

SEQ ID NO: 9922 - RNA, 2085 nt, Artificial Sequence
  ZIKV (isolate Z1106033) prME-short variant CDS opt
auggcuauaagcggaguaccaguccuagguuucuuuauaaucgcugucuuaaugucagcacaagaaucgugggccguaaccagaagaggaagugcauauuauauguauuuagaccgaaaugaugcaggcgaagcgauaucauuuccaacgacauuaggaaugaauaaauguuauauacaaauaauggauuuaggacacacaugcgaugcaaccaugucuuacgaauguccaauguuagacgaaggaguagaaccagaugacguagacuguugguguaauacaaccaguaccuggguaguuuacggaacaugucaucacaagaaaggagaagcaagaagaaguagacgagcaguaaccuugccaucacauucaacaagaaaauuacaaacaagaucacaaacaugguuagaaagucgagaauauacaaaacaucuaauaagaguagaaaacuggauauuuaggaacccuggauuugcacucgcagcagcugcaauugcaugguugcuaggaagcucuacuucccaaaaaguuauuuauuuaguaaugauauuauuaauagcaccagcauauucaauuagauguaucgguguaucuaauagagacuuuguagaaggaaugagcggagguacuuggguagaugucguauuagaacauggaggauguguaacaguaauggcccaagauaaaccaacgguagacauagaauuagucacuacaacuguuucaaauauggcugaaguuagaucauacuguuaugaagcaaguauaucagauauggccagugacuccagauguccaacccaaggagaagcauauuuagacaaacaaagugacacacaauauguaugcaaaagaacucuaguagauagaggcuggggaaauggaugcggauuauuuggaaaggggaguuuaguaacaugcgcaaaauuugcaugcucaaagaaaaugacaggaaaaaguauccaaccagaaaauuuagaauauagaauaauguuaucaguacauggaucgcagcacagcggaaugauuguuaacgacacaggacaugaaacagaugaaaacagagcaaaaguugaaauuacaccaaacucaccaagagcagaagcgacauuaggaggauuuggaucacuagguuuagauugugaacccagaacuggacuugauuucagugacuuauauuaucuuacgaugaauaauaaacacuggcuaguucacaaagaaugguuucaugauauaccacuuccauggcaugcaggagcagauaccggcacaccucacuggaacaauaaagaggcccuaguagaauuuaaagacgcucaugcaaaaagacagacuguugugguauuaggcucacaagaaggagcaguucacacugcgcuagcaggggccuuagaggcagaaauggacggcgcaaaagguagacucucaagcggacauuuaaaaugcagacugaaaauggauaaauuacgacuaaaaggaguuaguuauagccuauguacugccgcauuuacuuucacaaaaauaccagcagaaacacugcauggaacuguaacgguagaaguacaauacgccgguacagacggaccuuguaaaguaccagcacaaauggccguagauaugcaaacacuaacuccuguugguagacuaauaacugcaaauccuguaauaacagaaagcacagaaaauucaaaaaugauguuagaauuagauccaccuuuuggagauucauauauaguaaucgggguuggagaaaagaaaauuacacaccauuggcaucgaucaggaucaacaaucgguaaagccuuugaagcgacaguaagaggugcaaaaagaauggcaguauuaggagauacagcaugggauuuugguucgguaggaggagcauuaaauucacuaggaaaagguauucaccaaauauuuggagcagccuuuaaaaguuuauuuggaggaaugaguugguuuagucaaauuuugauaggaaccuuauuaauguggcuuggacucaacgcaaagaacggaucaauuagcuuaaugugucuagcguuaggaggaguuuugauauuccuaucaacagcaguaagugcu

SEQ ID NO: 9923 - RNA, 2073 nt, Artificial Sequence
  ZIKV (strain MR 766) prME-short variant CDS opt
auggccauaucaggaguaccaguauuagguuuuuucauaauagcaguacucaugucagcacaagaaucaugggcgauaacaagaagaggaucagcauauuacauguauuuagauagaucagaugcgggaaaagcaauuuccuuugcaacaacauuaggugugaacaaaugccauguacaaauuauggaucuuggucacaugugcgacgcaacaaugucguacgaaugcccuaugcuugacgaaggaguugaaccagaugacgucgauuguugguguaacacaaccucaacauggguugucuacgguacuugucaucauaaaaaaggggaagcaaggagaucaagaagagcuguaacacuaccaagucauucaacuagaaaauuacaaacaagaagccaaacauggcuagaaucucgagaauauaccaaacacuuaauaaaaguagaaaacuggauauuuaggaauccaggauucgcauuagucgccguagccauugccugguuacugggaucuaguacaagccaaaaagucauuuaccuaguaaugauacuuuuaauagcaccagcauacucaauucgguguauaggugucaguaacagggauuuuguugaagguaugaguggaggaacauggguagauguuguacucgaacacggcggaugugucacaguaauggcacaagauaaaccaacuguagacauagaacuaguaacaacaacuguaucaaacauggcggaaguuagaucauacuguuaugaagcaaguauaucagauauggcaucagauucacgcugcccaacacaaggcgaagcauauuuagauaaacaaagcgauacacaauauguaugcaaacgaacacuaguagacagaggcuggggcaauggaugcggauuauucggcaaaggaagucuuguaaccugugcaaaauuuacaugcucaaaaaaaaugacagguaaaaguauacaaccagaaaaucuagaauaucgaauaauguuaagcguacauggaucacaacauucuggaaugauuggauaugaaacggaugaagauagagcaaaaguagaaguaacaccaaauuccccaagagcagaagccacacuagguggcuuuggaucucuaggcuuagauugugaaccaagaacuggauuagauuuuucagauuuauauuauuugacaaugaauaauaaacauugguugguacauaaagaaugguuucacgauauaccuuuaccauggcaugcuggagcagacacaggaaccccacauuggaacaauaaagaagcauuagucgaguucaaagaugcccaugcaaaaagacaaacgguaguaguucuaggaucccaagaaggagcgguacauacagcacucgcaggagcacuagaagccgaaauggauggugcuaaaggaagauuauuuucaggacaucuuaaauguagauuaaaaauggauaaauuaagacuuaaaggaguaucuuauagucucuguacugcggcuuuuacauuuacaaaaguaccagcagaaacguuacaugguacaguaacaguagaaguacaauacgcaggaacagacgguccauguaaaauuccuguacaaauggcaguagauaugcaaacucugacaccaguagguagauuaauaacagcuaauccuguaauaacagagucaaccgagaacucaaaaaugaugcuagaauuagauccaccuuuuggagauucauauauagucauaggcguaggagacaaaaaaauaacacaucacuggcacagaucaggaaguacuauagggaaggcauuugaagcaacgguaagaggcgcaaaaagaauggcaguauuaggagauaccgcaugggauuuuggaaguguuggugguguguuuaacucuuuagggaaagggauacaucaaauauuuggagcagcauuuaaaagcuuguuuggagguaugucaugguuuucacaaauacuaauaggaacauugcuaguaugguuaggauuaaauacuaaaaauggaagcauaagcuuaacaugcuuagcauuagguggaguaaugauauuuuuaucaacagcaguaucagca

SEQ ID NO: 9924 - RNA, 2085 nt, Artificial Sequence
  ZIKV (strain NatalRGN) prME-short variant CDS opt
auggcuauuucugggguuccaguauuaggauucuuuauaauagcaguauuaaugucagcacaagaaaguugggcaguaacaagaagaggaagugcauacuauauguauuuggacagaaaugacgcuggagaagccauaaguuuuccaacaacauugggcaugaacaaauguuauauacaaauaauggauuuaggacauaugugugaugcaacaaugucauacgaauguccuaugcuagaugaaggagucgaaccagacgauguagauuguuggugcaauacaacuucaacauggguaguuuauggaaccugucaucauaagaaaggggaagcaagaaggaguagaagggcaguaacuuuacccucucauagcacaagaaaauuacaaacaagaucacaaacuuggcucgaaagcagagaauauacuaaacauuuaauaagaguagaaaauuggauuuucagaaauccaggauuugcucuagcagcagcagcaauagcaugguuacuugguuccaguacaagucaaaaaguaaucuaccuuguaaugauacuucuuauugcuccagcguauucaauaagguguauuggaguaaguaacagagacuucguagaagguaugucuggaggcacguggguagacguaguauuagaacacgguggguguguaacuguaauggcucaagauaaaccaacuguugauaucgaauuagugacaacaacaguuucaaacauggcugaaguacgaagcuacugcuacgaagcaucaauaagugauauggcaagugauagucgaugcccaacacaaggagaagcauaucuagacaaacaaagugauacacaauauguauguaaaagaacacuuguagauagaggauggggaaaugguugugggcuauuuggcaaagggagcuuagucaccugugcaaaauuugcuuguagcaagaaaaugacaggaaaaagcauacaaccagaaaaucuagaauauagaauaauguuaaguguccauggaucacaacauaguggaaugauaguaaaugacaccggacacgaaacugacgaaaaucgagcaaaaguggaaauaacaccaaauagucccagggccgaagcuacauuaggagguuuuggaucacuaggacuggauugugaacccaggacaggguuagauuucagcgauuuauauuauuuaacaaugaacaauaaacauugguugguacauaaagaaugguuucaugauauaccauuacccuggcaugcuggugcugauacaggcacaccucauuggaacaauaaagaagcauuaguagaauuuaaagaugcgcaugcaaaaagacaaacaguugucguuuuaggaagucaagaaggcgcaguacauacugcucuagcaggagcauuagaagcugaaauggauggagcaaaaggcagacugucaaguggacauuuaaaaugucgacuaaaaauggauaaauugcgauuaaaaggaguaucauauuccuuaugcacugcagcuuuuacauuuacaaaaauaccugcagaaacguuacauggaacaguuacaguagaaguucaauacgccggaacagauggaccauguaaaguaccagcacaaauggcaguagacaugcaaacauuaacaccugucggacgacuaaucacagcaaauccaguuauuacagaaucaacagaaaauaguaaaaugaugcuagaauuagauccaccauucggagauucauacauaguaauaggaguuggagaaaagaaaauaacacaccauuggcaucgaagcggaaguacaauaggaaaagcguucgaagcuacaguccguggagcaaaaagaauggcaguauuaggagauaccgcaugggauuuuggaaguguaggcggagcauuaaauaguuuaggaaaagguauacaccaaaucuuuggagcagcauucaaaucacuauuuggaggaaugagcugguuuucgcagauacugauagguacuuuauuaauguggcuaggauuaaauacgaaaaacgguagcauaucauugauguguuuagcacucgguggaguacuaauauuuuuaucuacagcuguauccgcg

SEQ ID NO: 9925 - RNA, 2064 nt, Artificial Sequence
  ZIKV (strain ZikaSPH2015) prME-short variant CDS opt
auggauuggacauggauuuuauuucuagucgcagcagcuacaagaguacacuccguaacaagaagaggaucggcauacuauauguauuuagacagaaacgaugcaggggaagcaauaucauuuccaacaacucuugguaugaauaaauguuacauacagauaauggauuuaggacacaugugcgaugccacuaugucguacgagugcccaauguuagacgaagggguggagccggaugauguagauugcugguguaacacuaccucuacauggguagucuauggaacaugucaccacaagaaaggagaagcaagaagaaguagacgagcaguaaccuuaccaagucauucaacaagaaaauuacaaacaagaucacaaacaugguuagaaucaagggaauauacaaaacauuuaauuagaguagaaaacuggauauuuagaaauccugguuuugcuuuggcagcagccgcuaucgcuugguuauuaggaagcagcacaucacaaaaaguaauauauuugguaaugauuuuacucauagcccccgcguauaguauucgauguauagguguaucuaauagagacuucguagaaggaaugucaggaggaacuuggguagacaucguauuagaacacggaggauguguaacaguaauggcucaagacaaaccgacaguagauauagaauugguaacaacaacuguuucuaauauggcagagguacgaucauacuguuaugaagcaagcaucagugauauggcuucagacagccgauguccaacacaaggugaagcauacuuagauaaacaaagcgacacacaauauguaugcaaaagaacguuaguagauagaggcuggggaaaugguugcggguuauucggaaaaggaucauugguaacaugcgcaaaauuugcauguucaaagaaaaugacuggaaaaucuauacaaccugaaaaucuagaauauaggauaauguuaaguguucauggaucucaacacucaggaaugauaguaaaugacacaggacacgaaacggaugaaaauagagccaaaguagaaauaacaccaaauucaccgagagcagaagcgacauugggaggauuugggucacuaggauuagauugugaaccgagaaccggguuagauuuuucugaucucuauuaucuaacaaugaauaauaaacauugguuaguacacaaagaaugguuccaugauauuccauuaccuuggcacgcaggagccgauacagguacuccacacuggaacaauaaagaagcauuaguagaauuuaaagacgcacaugcaaaaagacaaacaguaguaguauuaggaagucaagaaggcgcaguacacaccgcucuagcaggagccuuagaagcagaaauggauggagcaaaggguagauugucuucaggccaucuaaaauguagacuaaaaauggauaaacuaagauuaaaaggaguaagcuacucuuuaugcacagcagcauuuacguuuacaaaaauaccagcagaaaccuuacauggaacuguuacuguagaaguacaauaugcaggaacagauggaccauguaaaguuccagcacaaauggcaguagauaugcaaacauuaacaccaguaggaagauuaauuacagcaaauccaguaauuacagaaucaaccgaaaacucaaaaaugauguuagaauuagacccaccuuucggagacucauauauaguaauaggaguaggagaaaagaaaauuacacaccauuggcaccgauccggaucaacaauaggaaaagcauucgaagcuacaguacgaggcgcaaaaaggauggcagucuuaggagauacagcaugggauuuuggaagcguaggaggagcacuuaacuccuuagguaaaggcauacaucaaauauuuggagcagcguuuaaaucauuauuuggggguaugucuugguuuagccaaauacucauagguaccuuauuaauguggcuaggacuuaauacuaaaaacgguucaauuucauuaauguguuuagccuuaggagguguuuuaauauuucuuaguacagcaguuucagca

SEQ ID NO: 9926 - RNA, 2064 nt, Artificial Sequence
  ZIKV (isolate Z1106033) prME-short variant CDS opt
auggauuggacauggauauuauuuuuaguggcagcagcaacaagagugcacucagugaccaggagaggaagugcauauuauauguauuuagauagaaaugacgcgggagaagcaauaucauucccaacuacguuaggaaugaauaaauguuauauacaaauaauggauuuaggucauacaugugaugcaacaaugucuuacgaauguccgauguuagacgaaggaguagaaccagaugacguagacugcuggugcaauacaacaaguacuuggguaguauacggaacaugccaucacaaaaaaggagaagcuagaagaucucgaagggcaguaacuuuaccaagucauucuacacgaaaauugcaaaccaggucacaaacaugguuagaaucaagggaauacacaaaacaucugauaagaguagaaaacuggauauuuagaaaucccggguuugcauuagcugcagcagcaauagcauggcuuuuagguucaucaacaucucaaaaaguaauauaucuugugaugauacucuuaauugcaccugcuuacaguauuagguguauaggugucucaaauagagacuuugucgaagggaugaguggugguacauggguugauguugucuuggaacaugguggauguguaacaguaauggcacaagauaaaccaaccguagauauagaauuagucacaacgacaguaucuaacauggcagaaguuagaucuuauugcuaugaagcgucaauaucugauauggccucggacucaagaugcccaacacaaggcgaagcauaucuagauaaacaaucagauacccaguauguauguaaaagaacauuaguugauagagguuggggaaaugguugcggacuauuuggcaaaggaucauuaguaacaugugcaaaauucgcauguagcaaaaaaaugacaggaaaaucaauucaaccagaaaauuuggaguauagaauaaugcuaagugugcacggaagccagcauaguggaaugauuguaaaugauacaggacaugaaacugacgagaauagagcgaaaguagaaaucacaccaaauucaccaagagcugaagcuacacuaggaggauuugguaguuuaggccucgauugugaaccaagaacaggauuagacuucuccgaucuauauuauuuaacaaugaauaauaaacacuggcuaguucauaaagaaugguuucaugauauaccuuuaccuuggcaugcaggagcagauacaggaacuccucauuggaacaauaaagaagcacuaguagaauuuaaagaugcacacgcaaaaagacaaacaguagucguacuaggaagucaagaaggagcaguucauacagcuuuagcaggagcauuagaagcagaaauggauggagcaaaagggagauuaucaucaggacaccuaaaauguagauuaaaaauggauaaauuaagauuaaaaggaguaucauacucauuguguacagcagcauuuacauuuacaaaaauaccagcagaaacauuacauggaacagucacgguugaaguacaauacgccggaaccgacggaccaugcaaaguaccugcacaaauggcaguagauaugcaaacacuaacaccaguaggacgacuaauaaccgcgaauccaguaauaacagaaaguacagaaaauagcaaaaugauguuagaacuagauccuccauuuggagauucauacauaguaauuggagucggggaaaaaaagauuacucaccacuggcaucgaucgggcaguacaauaggaaaagcauuugaagcaacaguacgcggagcaaaaagaauggcaguacuaggagacaccgcaugggauuucgguucaguagguggagcauuaaauucauuagguaaaggaauacaccaaauauucggagccgccuuuaaaaguuuguuuggcggaaugaguugguuuagccaaauauugaucggaaccuuacuaauguggcuggguuuaaaugcaaaaaaugguagcauaagucuaaugugcuuagcacuggguggaguacuaauauuuuuaucaacggcaguaucagcg

SEQ ID NO: 9927 - RNA, 2052 nt, Artificial Sequence
  ZIKV (strain MR 766) prME-short variant CDS opt
auggauuggaccuggauauuauuuuuaguagcagcagcuacuagggugcauucaauaacaagaagaggaucagcuuacuauauguauuuagacagaagcgacgcaggaaaagcaaucagcuuugcuacaacacuagguguaaauaaaugucauguacaaauaauggauuuaggacauaugugugaugcaacaaugaguuacgaauguccuauguuagaugaagguguggaaccugacgauguagauuguuggugcaauacuacuagcacuuggguagucuauggcacaugucaucauaagaaaggcgaagcaaggagaaguagacgugcaguaacauugccaucucacaguacacgaaaauuacaaacuagaucacagacauggcuugaaucaagagaauauacaaaacacuuaauaaaaguagaaaauuggauauucagaaauccuggguucgcacuuguggcugucgcuauagcuugguuacuaggaaguaguacgagucaaaaaguuauauaucuuguuaugauauuacuaauagcaccagcauacaguauaagauguauagggguuucuaacagagacuuuguugaaggaaugucagguggaacauggguagacguaguauuagaacacggaggauguguaacuguaauggcacaagauaaaccaacuguugauaucgaacucguaacaacaacagugagcaauauggcggaagugagaucauacuguuaugaggcaucaaucucagacauggcaucagauucaagauguccaacucaaggugaagcguaucuggacaaacaaucagacacacaauauguauguaaaaggacauuaguugauagaggaugggguaauggaugcggacuauucggaaaagggagcuuaguaaccugugcuaaauuuacauguaguaaaaagaugacaggaaaaucaauacaaccagaaaauuuagaauacagaauaaugcuaucaguccauggcagucaacacagcggaaugauugguuaugaaacggacgaggauagagcuaaaguugaaguaacgccuaauaguccuagagcagaagcuacacuaggaggauuuggaucacuaggauuagacugcgaaccacgaacaggauuagauuuuagugauuuauauuaccuaacgaugaauaacaaacacugguuaguacacaaagaaugguuucacgauauaccauuaccauggcaugcaggcgcugauacaggaacaccacauuggaacaauaaagaggcuuugguagaauuuaaagacgcacaugcuaaaaggcagacaguaguaguauuaggaucacaagaaggagcugugcauacagcacuugcaggagcacuagaagcagaaauggacggggcaaaaggacgauuguucucaggacauuuaaaguguagacuaaaaauggauaaacuaagacuaaaagguguaucauauagccuauguacugccgcauuuacguuuacuaaagucccagcagaaacucuacauggaaccguaacugucgaagugcaauaugcagguacagauggcccuuguaaaauaccaguucaaauggcaguggacaugcaaacauuaacaccgguaggaagauuaauaacagcaaauccgguuauaacggaaucaacagaaaauaguaaaaugaugcuagaauuggauccaccauuuggugauucauauauaguaauaggcguaggagacaagaaaauaacacaucacuggcauagaagcggaucaacaauagguaaagcauuugaagcuacuguaagaggagcaaaaagaauggcaguccuaggugauacagcuugggacuuugguagcguaggaggaguguuuaauucacucggaaaagguauucaccaaaucuuuggagccgcuuuuaaaucauuauucggagguaugagcugguucucacaaauccuaauaggaacacuauuagugugguugggacuaaauacuaaaaaugguagcauaucacuaacauguuuagcauuaggagggguuaugauauuucuaaguacagcuguaagcgca

SEQ ID NO: 9928 - RNA, 2064 nt, Artificial Sequence
  ZIKV (strain NatalRGN) prME-short variant CDS opt
auggauuggacauggauauuauuuuuaguagcagcagcaacgagaguacauaguguaacaagacgagguuccgcauacuacauguauuuagauagaaaugaugcgggagaagccauaucauucccgacgacauuaggaaugaauaaauguuauauccaaauaauggauuuaggacacaugugugaugcaacaaugucauaugaauguccaauguuagacgaaggaguugaaccugaugauguagauuguugguguaacacaacuagcacguggguugucuauggaacaugucaucauaagaaaggagaagcaagacggaguaggagagcaguaacauugccaucacacaguacaagaaaacuacaaacacgaagucaaacaugguuagagagccgagaauauacaaaacaucuaauaagaguagaaaauuggauuuucagaaauccagguuuugcauuagcagcagcagcaauagccugguuauuaggaucaucaacaagucaaaaaguaauauauuuagucaugaucuuauuaauagcaccagcguauucaauacgauguauuggaguaucuaacagggauuucguagaagguaugucaggaggaacauggguagauguaguacuugagcauggaggaugugugacaguaauggcacaagauaaaccaacgguugauauagaauuaguaacaacaacaguaucaaacauggcagaaguaagaaguuauugcuaugaagcaagcauaucagauauggcuucugacagucgauguccaacacaaggagaagcauauuuagacaaacaaucugauacucaauaugucugcaaaagaacauugguagauaggggguggggaaauggauguggauuguuuggaaaaggaagucuaguaacgugugcaaaauuugcuugcucgaaaaaaaugacuggaaaaaguauacaaccagaaaaucuugaauauagaauaauguuaaguguucauggaagucaacauucaggaaugauuguaaaugauacuggacaugaaacggacgaaaauagggccaaaguagaaauaacaccuaauaguccuagagcugaagccacauuaggaggauucggaucauuaggacucgacugugaaccaaggacaggacuagauuucucugacuuguauuacuuaacaaugaauaauaaacauugguuaguacacaaagaaugguuucacgauauaccacuaccauggcaugcgggagcugauacagguacuccacacuggaauaauaaagaagcacucguagaauuuaaagacgcacacgcaaaaagacaaacaguuguaguauuagguucacaagagggcgcaguacauacagcauuagcaggugcuuuagaagcugaaauggacggagcaaaaggaagauuaucaaguggacaccuaaaaugcagauugaaaauggauaaauuacgauuaaaaggaguaucuuauagccuuuguacugccgcauuuaccuuuacaaaaauaccagcagaaacauuacauggaacuguaacaguagaaguacaauacgcuggcacugacggaccauguaaaguaccggcucaaauggcgguagauaugcaaacauuaacaccaguaggucgccuaauaacagcaaauccaguaauaacugaaagcacugagaauuccaaaaugauguuagaauuggauccaccuuuuggagauucauacauaguaauuggaguaggugaaaaaaaaauaacacaucacuggcauagauccggaucaacaauaggaaaagcauuugaagcaacaguucguggggcuaaaagaauggcaguacuaggagauacagccugggauuucggaucgguaggaggugcauuaaacucauuaggaaaagguauacaucaaauauuuggagcagccuucaaaagucucuuuggaggcaugaguugguucagucaaauauugauaggaacucuauuaauguggcucggcuuaaauacaaaaaaugguucaauuucauuaauguguuuagcauuaggaggaguauuaauuuucuuaucaaccgcaguauccgcu

SEQ ID NO: 9929 - RNA, 2082 nt, Artificial Sequence
  ZIKV (strain ZikaSPH2015) prME-short variant CDS opt
augggaaaaagaucagcuggaaguauaaugugguuagcaucauuagcuguaguaauagcaugcgcaggagcuguaacaagaagaggaagcgcauauuauauguaccuagauagaaacgacgcaggagaagcuaucucuuuuccaacaacauuaggaaugaauaaauguuauauacaaauuauggauuuaggacauaugugcgacgcaacaaugucauaugaauguccuauguuagacgaaggaguagaaccagacgauguagauuguugguguaauacaacaaguacuuggguaguuuauggcacaugccaucauaagaaaggggaagcucgaagaagcagacgagcaguaacauuaccaagucauagcacaagaaaacuacaaacaagaagccaaacaugguuagaaucuagagaauauacuaaacauuuaauacgcguagaaaacuggauauucagaaauccaggauuugcacuagcagcagcagcaauagcaugguuauuaggaucaaguacaucacaaaaaguaauauacuuaguaaugauacuauuaauagcaccagcuuacucaauaagaugcauaggaguaucaaaucgugacuuuguagaaggcaugagcgggggcacauggguagauauuguacuagaacauggugguuguguuacaguuauggcucaagauaaaccuaccguugauauagaguuaguaacaacaacaguaagcaauauggcagaaguaagaucauacuguuacgaagcaucaauaagcgauauggcaucagauaguagaugcccaacucaaggagaagcauacuuagauaaacaaucagauacacaauauguaugcaagcgaacccuaguggaccgaggauggggaaauggauguggacuauuuggaaaaggcucucuuguuacaugugcaaaauuugcauguucuaagaaaaugacaggaaaaucaauacaaccugaaaacuuagaauacagaauaauguuaagcguucauggaagucaacacucagguaugauaguaaaugauacaggacacgagaccgaugaaaacagagcaaaaguagaaauaacacccaacucaccaagagcagaagcaacccuuggcgguuuuggaaguuuaggauuagauugugagccuagaacugguuuagauuucucagauuuauauuauuuaacuaugaauaauaaacauuggcuaguccauaaagaaugguuucaugauauaccuuugccauggcaugcgggugcagauaccggaacaccacacuggaacaacaaagaagcacuuguagaauuuaaagaugcccacgcaaaaagacaaacuguaguaguacuuggaagucaagaaggagcaguucauacugcauuagcaggagcauuagaagcagaaauggauggagccaaaggaagauuaaguucuggacaucuuaaauguagguuaaaaauggauaaauuaagacuaaaaggcguuucauacucauuauguacagcagcauucaccuucacaaaaauaccagcugaaacauuacacggaacaguaacaguugaaguucaauaugcaggaacugaugggccauguaaaguaccugcacaaauggcaguagauaugcaaacacuaacaccaguaggaagacuaauaacagcaaacccuguaauuacggaaucuacagaaaacagcaaaaugauguuagaguuggauccacccuuuggagauagcuauauaguuauaggagugggugaaaagaaaauaacgcaucauuggcacagaagugguaguacaauaggaaaagcauuugaggcaaccguaagaggggcaaaaaggauggcaguccuaggagacacagcuugggacuuuggaagcguaggcggggcccuuaauuccuuaggaaagggaauacaccaaauauuuggagcagcauuuaaaucauuauucgguggcaugucuugguuuucucaaauacuaauaggaacauuauuaauguggcuuggacuaaauaccaaaaauggcucaaucucauuaaugugucuugcuuuaggagguguacuaauauuuuuaaguacagcaguaagugca

SEQ ID NO: 9930 - RNA, 2082 nt, Artificial Sequence
  ZIKV (isolate Z1106033) prME-short variant CDS opt
auggguaaaagaucagcuggaucaauaaugugguuagccucacuagcaguuguuauagcaugugcuggagcgguaacuagaagagguagugccuauuacauguaccuagauagaaacgaugcaggagaagccauaucauuuccaacaacauuagguaugaauaaaugcuauauucaaauaauggauuuaggacacacaugugaugcaacaaugucuuaugaauguccaauguuagaugaaggaguugaaccagaugauguagauuguugguguaauacaacaaguacauggguuguauacggaacgugucaucauaaaaaaggagaagcacgaagaaguagacgagcugucacauuaccaagucauagcacucguaaauuacaaacaagaagucaaacuuggcuagaaagcagagaauauacgaagcaucuaauaaggguugaaaacuggauauucagaaacccaggauuugcuuuagcagcugcugcaauagcauggcuauuaggaagcucaacaagucaaaaagucauauauuuaguaaugauacuucuaauagcaccagcauacaguauuagaugcauaggaguaaguaauagggauuuuguagaaggaaugaguggagguacauggguugacguaguauuagaacauggaggauguguaacaguaauggcacaagacaaaccuacaguagacauagaauuaguaacaacuacaguuucuaauauggccgaaguacgaagcuauuguuaugaggcaucaauaucagauauggcaucagacucaagauguccaacucaaggggaagcguaucuagauaaacaauccgacacccaauacguauguaaacgaacacuuguagauagaggauggggaaacgguuguggauuauuugguaaagguaguuuaguaacuugcgcaaaauuugcauguucaaaaaagaugacaggcaaaucaauacaaccagaaaaccuggaauauagaauaauguuaucaguacauggcucacaacauagugguaugaucguuaacgauacuggacaugaaacagaugaaaaucgagcgaaaguagaaauaacgccaaauucaccuagagcugaagcaacauuaggaggauuugggagcuuaggacuugacugugaaccuagaacaggauuagauuucagcgaucuauacuaucuuacgaugaauaauaaacauuggcucguacacaaagagugguuucaugauauuccucuuccauggcacgcaggagcugauacugggacaccacauuggaauaauaaagaagcuuuaguagaauucaaagaugcacacgcaaaaagacaaacaguaguuguguuaggaucucaagaaggagcgguacauacagcauuagcaggagcccuagaagcagagauggauggagcaaaaggacgguuaucaucaggacaucuaaaauguagacuuaaaauggacaaauuaagacuaaaaggaguaucuuauucauuaugcacagcagcauuuaccuuuacaaaaauaccggcagaaacacuucauggaacaguuacaguagaaguacaauacgcaggaacagauggcccaugcaaagucccagcacaaauggcuguagauaugcaaacauuaacuccaguagguagacuuauaacagcaaauccgguaauaacagagucaacggaaaauucaaaaaugauguuagaacuagauccaccauuuggagacaguuacauaguuauuggcgucggagaaaaaaaaauaacacaucacuggcauaggagcggaaguacaauuggaaaagcauucgaagcuacaguuagaggagccaaaagaauggcuguauuaggagacacugcgugggacuuuggaaguguaggaggcgcauuaaauagcuuagguaaaggaauacaucaaauauuuggugcggcauucaaaucacuguucggaggaaugaguugguuuucacaaauacuaaucggaacuuuacuaaugugguuagguuuaaaugcaaaaaauggaucaauaaguuuaaugugccuggcauuaggaggaguauugauauuuuuaagcacagcagugucagca

SEQ ID NO: 9931 - RNA, 2070 nt, Artificial Sequence
  ZIKV (strain MR 766) prME-short variant CDS opt
augggaaaaagaucagcagggaguauaaugugguuagcaagucuagcaguugucauagcgugcgcaggugcaaucacuagaagaggaagcgcauauuacauguauuuagauagaagugaugcaggaaaagcaauuucauuugcuacaacauuaggcgucaauaaaugucauguacaaaucauggauuuaggucauaugugugaugcaaccaugagcuacgaauguccaauguuagaugaaggaguagaaccugaugacguagacugcugguguaauacaacaaguacauggguaguauauggaacgugccaucacaaaaaaggagaagcaagaagaagccgaagagcggucacccuaccaagucauagcacuagaaaauuacaaacaaggagucaaacauggcuagaaagcagagaauauacaaaacacuuaauaaaaguagaaaauuggauauuucguaauccaggcuucgcacuaguagcaguagccauagcaugguugcuuggaucaucgacaagucaaaaaguuaucuauuuaguaaugauauuauuaauagcgccugcauacucaauacgauguauaggaguaucuaacagagauuucguagaaggaaugucuggagguacuuggguagauguaguucuggaacaugguggauguguuacuguaauggcccaagacaaaccaaccguagauauugaacuaguaacuacuacuguaagcaacauggcggaaguacgaucauauuguuacgaagcaaguauaagugauauggcaucagauucuagaugcccgacccagggagaagcauauuuagauaagcaaagugacacccaauacguauguaaaagaacauugguagauagaggauggggaaacggauguggauuauucggcaaaggaaguuuaguaacaugugcuaaauuuaccugcaguaaaaaaaugacaggcaaaaguauacaaccagaaaauuuagaauacagaauaaugcuaagcguacauggaucucaacauucaggaaugauaggauaugaaacagaugaagauagggcuaaaguagaagucacaccuaauagcccaagagcggaagcgacccuggguggguuuggaucauuaggauuagauugcgaaccgagaaccggauuagauuuuagugauuuauauuauuuaacaaugaacaauaaacauugguuagugcauaaagagugguuccaugacauaccacuaccauggcaugcaggugcagacacuggaacaccacauuggaauaauaaagaagcauuagucgaauucaaagaugcucaugcgaaaagacaaacaguagugguucuaggaucucaagaaggagcaguacacacagcauuagcaggagcgcuagaagcagaaauggauggcgcaaaaggaagauuauucagcggucauuuaaaauguagauuaaaaauggauaaauuaagacuuaaaggaguaucauauucucuaugcacagcagcauuuacuuuuacuaaaguaccagccgaaacauuacauggcacgguaacugucgagguacaauaugcagguacagacggaccuuguaaaauaccaguacaaauggcaguggauaugcaaacauuaacuccaguaggcaggcuaauaacagcuaauccaguaauaacagaaucaacugaaaacagcaaaaugauguuggaauuagauccaccauuuggcgauuccuauauaguaauagggguaggagauaaaaaaauaacacaccauuggcacaggaguggaaguacaauagggaaagcauuugaagcgacaguaagaggagcaaaaaggauggcaguacuaggagauacagcaugggauuuugguagcgugggagguguauuuaacucacuaggcaaggggauacaucaaauauuuggcgcagcauuuaaaagcuuauuuggaggaaugaguugguuuucacaaauucugauaggaacucuuuugguaugguuaggauuaaauacaaaaaacgguucuauaaguuuaacaugucuagcauuaggggguguaaugauauuucuaaguacugcaguaagcgca

SEQ ID NO: 9932 - RNA, 2082 nt, Artificial Sequence
  ZIKV (strain NatalRGN) prME-short variant CDS opt
augggaaaaagaucagcagguucaauaaugugguuagcaucauuagcgguaguaauagcaugugcaggagccguaacgcguagagguucagcuuauuauauguaucuugauagaaacgaugcuggugaagcaauaucauuuccaaccaccuuaggaaugaauaaauguuauauacaaauaauggaccuaggacauaugugugacgcgacaaugucauacgagugcccuauguuagacgaaggaguagaaccagaugacguagauuguugguguaauacaacgucaacguggguaguauauggcacaugccaccauaagaaaggugaagcucgcagaagcaggagagcaguuacauugccaagccauucgacuagaaaauugcaaaccagaagucaaacaugguuagaaaguagagaauauacuaaacaucugauacgaguagagaacuggauauuuagaaauccaggauucgcguuagcagcggcagcaauagccugguuauuaggaaguucaacaagucagaaaguaauauaucuaguaaugauacuauuaauugcuccugcauauucaauaagauguauaggaguaucaaauagagauuuuguagaaggaaugucuggcggaacuuggguagauguaguacuagaacacggggguugugucacuguaauggcacaagauaaaccaacaguggauauagaauuaguaaccacaacaguaaguaauauggcagaaguaagaucauauuguuaugaagcaaguauaagugacauggcaucagauagcagauguccaacacaaggcgaagcauacuuagauaaacaauccgacacacaauacguauguaaaagaacauuagucgauagaggauggggaaauggauguggauuauuuggaaaagggucauugguaacaugugcaaaauucgcauguagcaagaaaaugacuggaaaaucaauacaaccagaaaauuuggaauaucgaauaauguuaaguguacauggcucucaacauucagggaugauuguaaacgacacuggacaugaaacagaugaaaacagagcaaaaguagaaauaaccccgaauaguccuagagcagaagcaacacuagguggauuugggucauuagguuuggauugugaaccaagaacaggcuuagauuuuagugaccuauauuaccugacuaugaauaauaaacauuggcuaguacauaaagaaugguuucaugauauaccauuaccauggcacgcaggagcugauaccggaacuccacauuggaauaacaaagaagcauugguugaauuuaaagaugcucacgcaaaaagacaaaccguaguaguacuaggcucacaagaaggagcgguccauacagcacuagcaggagcacuagaagcagaaauggacggggcaaaaggaagguuaucaaguggacauuuaaaguguagacuaaaaauggacaaauuacgauuaaaaggaguaucauauucauuauguacagcagcauuuacuuuuacuaagaucccagcagaaacauugcacggaacaguaacuguagaaguucaauaugcaggaacugauggaccaugcaaaguaccugcucaaauggcuguugacaugcaaaccuuaacccccguaggacgauuaauaacagcaaauccgguuauaacagaaucaacugaaaauaguaaaaugauguuagaacuagauccaccauuuggugauaguuacauaguuauaggaguaggagaaaagaaaauaacacaucauuggcauaggagcggaucaacaauagggaaagcauuugaagcaacaguaagaggagccaaaagaauggcaguauuaggagauacggcgugggauuuuggaagcguuggaggcgcauuaaauucccuaggaaaaggaauacaucaaauauucggagcagcauuuaaaucauuauuugguggaaugucuugguuuagucaaauacuaauaggaacauuauuaaugugguuaggauuaaauacuaaaaacggaucaauaagccugaugugcuuagcacuagguggaguacuaaucuuuuugaguacagcagugucagcc

SEQ ID NO: 9933 - RNA, 2085 nt, Artificial Sequence
  ZIKV (strain ZikaSPH2015) prME-short variant CDS opt
auggcaauaagcggaguaccaguauuaggauuuuuuauaauagcaguuuuaauguccgcucaagagagcugggccguuacuagaagaggaagugcauauuauauguaucucgauagaaaugacgcaggagaagcgauaucauuuccaacaacauuaggaaugaauaaaugcuauauacaaauuauggaucuaggacauaugugugaugcaacaaugaguuacgaauguccaauguuagaugaaggcguagaaccugaugauguagacuguuggugcaacacaacuucaacauggguaguauacggaacgugucaucacaaaaaaggggaagcacgaagaucaagaagggcaguaaccuuaccaucacacucaacuagaaaauuacaaacuagaagucaaacauggcuagaaucaagagaauauacaaaacauuuaauucgaguagaaaacuggauauucagaaauccaggauuugcacuagcagcagcggcaauagcaugguuacuaggaucaucaacuucacaaaagguaaucuaucuaguuaugauacuucucauagcaccagcuuacaguauuagaugcauugguguaucuaaucgagauuuuguugaaggaauguccggaggaacguggguagacauaguuuuggaacauggaggauguguaacggugauggcacaagacaaaccaacaguagauauugaauuagugacaacaacaguuucaaauauggcugaagucagaagcuauuguuaugaagcaaguauaagugauauggccagugauucaagaugcccuacacagggggaagcauaucuugauaaacaaucugauacucaauaugucuguaaaagaacuuuaguugauagaggauggggcaauggauguggcuuauucggaaaaggaaguuuaguaacaugugcuaaauucgcauguucaaaaaaaaugacaggaaaaagcauacaaccugaaaaucuagaauaucguauaauguuaaguguacacggaucacaacacucaggaaugauaguuaaugauacuggacaugaaacagaugaaaacagagcaaaaguagagauuacaccaaauaguccgcgcgcugaagcaacauugggaggauuuggaagccuagguuuagacugugaaccaagaaccggucuagauuuuucagaccuauacuauuugacaaugaauaacaaacauuggcuaguucauaaagaaugguuucaugauauaccacuacccuggcacgcaggagcagauacaggaacaccucauuggaauaauaaagaagccuuaguagaauucaaagaugcacaugccaaaagacaaacaguaguaguauuaggaucacaagaaggagcuguucauacagcacucgcaggcgcauuagaagcugaaauggauggagcuaaaggacgacuaucuucuggacacuuaaaaugucgguuaaaaauggauaaauuacgauuaaaaggaguaucauauagccuauguacugcggcauuuaccuucacaaaaauaccagcagaaacacuacauggaacagucacgguagaaguacaguaugcaggaacagauggaccauguaaaguaccagcucaaauggcaguugacaugcaaacacuaacaccaguaggaagacuaauaacugcaaauccuguaaucaccgaaaguacugaaaacaguaaaaugaugcuugaauuagauccaccguuuggagauagcuauauaguaauaggaguuggagaaaaaaaaauaacccaccauuggcacaggaguggaucaacauuaggaaaagcuuuuucuacaacauugaaaggagcgcaacgucuagcugcauuaggagacacagcuugggauuuuggaucaauaggaggaguauuuaauucaauaggaagagccgugcaccaaguauucggaggagccuuuagaaccuuauucggcggaaugaguuggauaacacaaggacuaaugggagcucuauuacuauggaugggaguuaaugccagagauagauccauugcacuggccuuuuuagcgacaggagggguauuaguauuuuuagcaacaaauguacaugca

SEQ ID NO: 9934 - RNA, 2085 nt, Artificial Sequence
  ZIKV (isolate Z1106033) prME-short variant CDS opt
auggcaauaagcggaguaccaguauuaggauucuuuauaauagcaguacuaaugucagcucaagaaaguugggccguaacaagaagaggauccgcauauuauauguaucuagauagaaaugaugcuggugaagcaauaucuuucccuaccacauuaggaaugaauaaauguuauauacaaauuauggaucugggacacacaugugaugcaacgaugucuuacgaguguccaauguuagacgaagguguugaaccagacgauguugauuguuggugcaacaccacaucaacuuggguaguauaugguacaugucaucacaaaaaaggcgaagcgagaagaucaaggagagccguaacauuaccaagucacucaacuaggaaauuacaaacaagaucacaaaccugguuagaaucaagagaauauacaaaacauuuaauaagaguagaaaauuggaucuuucgaaacccaggauuugcuuuagcugcagcagcaauagcuugguuauuaggaucaagcacaucacaaaaaguaauauauuuaguaaugauauuacuaauagcuccagcauacuccaucagauguauuggugucuccaauagagauuucguugaaggaaugagcggaggaacuuggguagauguaguuuuagaacauggcggauguguaacuguaauggcacaagauaaaccaacaguagacauagaguuaguuacaacaaccguauccaauauggcugaaguaagaagcuauugcuaugaagcuucaauaucugauauggcaagugacucaagaugcccaacacaaggugaagcauaucuagacaaacaaucagacacacaauauguauguaaaaggacacuaguagacagaggauggggaaaugguuguggcuuauuugggaaagggaguuuagucacaugcgcaaaauucgcauguucaaaaaaaaugacaggaaaaucaauccaaccagaaaaucuagaauaucguauaaugcuaucuguucauggaucucaacauagcggaaugauuguaaaugacacaggacacgaaaccgaugaaaacagagcaaaaguagaaauaacaccaaauuccccaagagccgaagcaacacuaggagguuuuggaucuuuaggacucgauugugaaccaagaacaggauuggauuucagcgaccuuuauuacuuaacaaugaauaauaaacacugguuaguacauaaagagugguuccaugauauuccauuaccuuggcacgcaggagcugauacaggaacuccacacuggaauaauaaagaagcauuaguagaauucaaagaugcacacgcaaaacgacaaacuguaguaguauugggaucacaagaaggagcagugcauaccgcauuagcuggagcacuagaggcagaaauggauggagcaaaaggccgauuaucaucaggacaucuuaaaugucgucuaaaaauggauaaauugagacuaaaaggcguaucauauucacuuuguaccgcugcuuuuacuuuuaccaaaauaccagccgaaacucuacaugguaccguaacagucgaaguucaauaugcagggacagauggaccauguaaaguuccagcacaaauggcagucgacaugcaaacauuaacgccgguaggaagguugauuacagcaaauccaguaauuacagaaagcacagaaaauucaaaaaugauguuagaauuagauccacccuuuggagauaguuauauaguaauaggaguaggagaaaaaaaaauuacacaccacuggcaccggucaggaucuacucuaggaaaagcuuuuaguacuacauuaaaaggagcacaaagauuagcagcacuaggagauacagccugggauuuuggaucuauagguggaguguuuaacuccauaggaagagcuguacaccaaguuuuuggcggugcuuuuagaacucuuuuuggugguaugucauggauaacacagggacuuaugggggcuuuacuacuguggaugggaguaaacgccagagauagaucuauagcacuagccuuucuagcaacaggaggaguauuagucuucuuagcaacuaauguacacgca

SEQ ID NO: 9935 - RNA, 2073 nt, Artificial Sequence
  ZIKV (strain MR 766) prME-short variant CDS opt
auggccauaaguggaguaccuguauugggauucuuuauaauagcgguauuaaugucagcacaagaaucaugggcgauaacaagaaggggaagcgccuauuauauguacuuagauagaagcgaugcaggaaaagcaauaaguuuugcaacuacucuaggaguaaauaaaugccauguucaaauaauggauuuaggacacaugugugaugcuacaaugucuuaugaauguccgauguuagacgaaggagucgaaccugacgauguggauugcugguguaacacaacuucaacauggguaguauacggaacuugucaucauaaaaaaggugaagcgcgaagaucccgaagagcaguaacucucccuagucacucaacacgaaaguuacaaacaagaagucaaacuugguuagagaguagagaauauacaaagcacuuaauaaaaguagaaaauuggauuuuuaggaauccagguuuugcgcuuguagcaguagcaaucgcuugguuauuaggaucaucaacaucacaaaaaguaauauacuuaguaaugauauuacucauagcaccagcauacaguauaagauguauugggguaaguaaucgagauuuuguggaaggaaugagugguggaacauggguggauguaguacuugagcacggaggcugcguaacuguaauggcucaagauaaaccaacaguagauaucgaauuaguaacuacuacaguuucaaacauggcugaaguaagaucguauuguuaugaagcgagcauaucagauauggccagugacucaagaugccccacgcaaggagaagcauaucuugauaaacaaagugauacucaauauguauguaaaagaacauuaguagaccgaggauggggaaauggcuguggauuauucgguaaaggaaguuuaguaacaugcgcaaaauuuacauguucaaaaaaaaugacaggaaaaagcauucaaccggaaaaccuagaauaucgaauuauguugucgguucacggaagucagcauagcggaaugauaggauaugaaacagaugaagauagagcaaaaguagaaguaacaccaaauaguccacgugcagaagcaacucucggcggguuuggaagucuaggacuagauugugaaccaagaacaggacuagauuuuagugaucuauacuauuuaacaaugaauaauaaacauugguuaguccauaaagaaugguuucaugauauaccacuuccauggcaugcuggagcagauacaggcacaccacauuggaauaauaaagaagcucuaguagaguuuaaagacgcccaugcaaaaagacagacagugguuguacuagguagccaagaaggagcuguucauacagcauuagcaggagcccuugaagcagaaauggauggagcuaaaggaagauuauuuaguggacauuuaaaaugcagacucaaaauggauaaacuuagacuaaaagguguaucuuacagucuaugcacagccgcauuuacauuuacaaaagucccagcagagacacuacacggaacagugacaguagaaguacaauaugcaggcacugauggaccaugcaaaauacccguacaaauggcaguagauaugcaaacguuaaccccaguaggaagacuaaucacugcaaacccaguaauuacagaaaguacugagaauucaaaaaugaugcuagaauuagauccaccauucggagacaguuacauagugauaggaguaggagauaaaaaaauuacacaucauuggcauagaucagguaguacauuaggaaaagcauuuagcacaacauuaaaaggagcacaaagauuagcagcauuaggcgauacagcaugggauuuugggagcauagguggcguauucaacucuauaggcagggccgugcaucaaguauuugguggagcauucagaacucuauuuggaggcaugucauggauuacacaagguuuaaugggagcauuacuauuauggaugggaguaaaugcaagagauagaaguauagcauuagcguuuuuagcaacaggaggaguuuuaguauucuuagcaacuaauguccacgca

SEQ ID NO: 9936 - RNA, 2085 nt, Artificial Sequence
  ZIKV (strain NatalRGN) prME-short variant CDS opt
auggcaauuucaggaguaccaguauuaggauucuuuauuauagccguacuaaugucugcacaagaaagcugggcggugacaagaaggggaagcgcauacuauauguaucuagacagaaaugaugcaggagaagcaauaucuuuuccuacaacauuaggaaugaauaaauguuauauacaaauaauggacuuaggacauaugugugaugcaacgaugagcuaugaaugcccgaugcucgacgaagguguagaaccagaugauguagauuguugguguaauaccacuagcacauggguagucuauggaacgugccaucauaaaaagggcgaagcccgaagaucuagacgagcaguaacguugccaucucauaguacaagaaagcugcaaacaagaagucaaacauggcuagaaucgagagaauauacaaaacacuuaauuagaguagaaaauuggauauuuagaaauccaggauuugcuuuagcagcugcagcaauagccuggcuauuaggaucaucaacaagucaaaaagugauauauuuaguaaugauacucuugauagcaccagccuauucaauaagauguauagguguaucaaacagggauuuuguggaaggaaugaguggaggaacuuggguagacgucgucuuagaacauggaggauguguaacaguuauggcacaagauaaaccaacaguagauauagaauuagucacaacuacuguaucuaauauggcagaaguaaggucauacugcuaugaagcaucaauuagcgauauggcuagugauaguagaugcccaacucaaggagaagcauaucuagacaaacagucagauacacaauauguaugcaaaagaacacuuguagauagaggguggggaaacggauguggacuuuuugggaaaggcagcuuaguaacaugugcaaaauuugcaugcaguaagaaaaugacuggaaaaaguauacagccagaaaaccuagaauacagaauaauguuaaguguacacggaucucaacauaguggaaugauaguaaaugauaccggacacgaaacugaugaaaaucgagcuaaaguagaaauaaccccaaacaguccgagagcagaagcaacuuuaggaggauuuggaaguuuaggacuagacugugaaccaagaacaggacuugacuuuucugaucucuauuacuuaacaaugaauaauaaacacuggcuaguacauaaagaaugguuucaugauauaccacuaccauggcaugccggugcagauacuggcacaccucauuggaauaacaaagaggcuuuaguagaauuuaaagaugcacaugcaaaaagacaaacaguaguagugcuaggaucacaagaaggugcaguacacaccgcacuagccggagcauuagaagcugaaauggauggugcaaaaggaaggcuaucaucaggacauuuaaaauguagguuaaaaauggauaaacuaagauuaaaaggaguaucauauucauuauguacugcagcauucacauuuacaaaaauaccggccgaaacgcuacauggaacuguaacaguugaaguucaauaugcgggaacagauggaccgugcaaaguaccagcacaaauggcaguagauaugcaaacucuaacaccaguuggaagauugauaacagcuaauccaguuauaacagaaaguacagaaaacaguaaaaugaugcuagaauuagauccaccguuuggagauucuuacauuguuauaggaguaggugagaagaaaauuacucaucacuggcauagaaguggcucaacacuaggaaaagcauucagcacuacacuuaaaggagcacaaagauuagcagcucuaggggauacagccugggacuucggcucaaucggaggagucuucaauaguauagggagagcaguacaccaaguauuuggaggagcauuuagaacauuauuuggagguaugagcuggauaacucaagguuuaaugggagcacuucuccuauggaugggugucaacgcaagagaccguaguauagcuuuagcuuuucuagcaacaggaggaguauuaguauucuuagcaacaaacguccaugcg

SEQ ID NO: 9937 - RNA, 2064 nt, Artificial Sequence
  ZIKV (strain ZikaSPH2015) prME-short variant CDS opt
auggauuggacauggauauuauuuuuaguagcagcugcaacaagaguacauaguguaacaaggcgcggaagcgcuuacuauauguaucuggauagaaacgaugcaggagaagcuauaucauuuccuaccacacuuggcaugaauaaauguuauauccaaauaauggaucuuggucauaugugcgacgcaaccaugaguuacgaaugcccaaugcuagaugaagguguagaaccugaugaugucgauuguuggugcaacacgacuucgacuuggguaguauaugguacaugucaucacaaaaaaggagaagcuagaagaaguagaagagcagucacauuaccaucacauucaacaaggaaauuacagacaagaagucaaacauggcuagaaucaagagaauauaccaaacauuuaauaagaguugaaaauuggauauucagaaauccaggauuugcauuagcagcugccgccauagcaugguuauuagggaguucaacaucacaaaaaguaauuuacuuaguuaugauucuuuuaauagcaccugcauauagcauuagauguauuggaguaaguaauagagauuuuguggaaggaaugucugguggaacauggguggauaucguacuggaacauggaggauguguaacuguaauggcgcaagauaaaccaacuguagacauagaauuaguuacaacuacaguaucaaauauggccgaaguuagaaguuauuguuaugaagcaucaauaagugauauggcaucagauaguagguguccaacacaaggagaagcuuauuuggauaaacaauccgacacacaauacguaugcaaaaggacucuaguugauagaggauggggaaauggaugcggauuauucgguaaaggaucauuaguuaccugugcuaaauucgcguguucuaaaaaaaugacagggaaaaguauucaaccagaaaaccuagaauacagaauuaugcuuagugugcauggaagccaacauucaggaaugauugucaacgacacaggucaugaaacagaugaaaaucgagcaaaaguagaaauaacaccuaauucaccacgugcagaagcaacauuaggaggauuuggaucauuaggauuagauugugaaccaaggacaggauuagauuucagcgacuuauacuaucugaccaugaauaauaaacacugguuaguacacaaagaaugguuccaugauauaccauuaccauggcacgcaggagcagacacaggaacaccacacuggaauaauaaagaggcccuuguggaauucaaagaugcacaugcaaaacgacaaacaguaguaguacuuggaucacaagagggagcaguucauacagcauuagcaggagcacuugaggcagaaauggacggugcaaaaggaagauuaaguaguggacauuuaaaauguagacuaaaaauggacaaacuaagauuaaaaggaguuagcuauaguuuauguacagcagcauucacauucacaaaaauuccagcagaaacauuacacggaacagucacaguagaaguacaauaugcaggaacagacggaccauguaaaguuccggcacaaauggcaguagauaugcaaacauuaacaccaguuggacguuuaauaacagcuaauccaguaauaacugaaagcacggaaaauucuaaaaugaugcuagaacucgauccaccuuuuggagauucuuacaucguaauaggagugggggaaaaaaaaauuacucaccacuggcauagaaguggaucaacauuagguaaagcauucaguacaaccuuaaaaggagcacaacgacuagcagcauuaggcgacacagcaugggauuuugguucgauaggaggaguguuuaauucaauaggacgcgcaguucaucaaguuuuuggaggagcauuuagaacauuauuuggaggaaugucauggauaacacagggacuuaugggagcccuauuauuauggaugggagugaaugcuagagauagaucaauagcucuagcauucuuagcaacaggugguguauuaguguuucuagcaacaaauguacacgcu

SEQ ID NO: 9938 - RNA, 2064 nt, Artificial Sequence
  ZIKV (isolate Z1106033) prME-short variant CDS opt
auggacuggacuuggauacucuuuuuaguagcugcagcaacaagaguacacucaguaacacgaaggggauccgcauauuauauguauuuagauagaaacgaugcaggcgaagcaauuucauuuccaacaacauuaggcaugaauaaaugcuauauucaaauaauggaccuagggcauacaugcgaugccacuaugagcuaugaauguccaauguuagaugaaggaguggaaccagaugauguagacugcugguguaauacaacaaguacauggguuguauauggcacaugccaucauaaaaaaggggaagcaagaagauccagaagagcuguaacauuaccuagccauaguacaagaaaauuacaaacaagaagccaaacauggcuagaaucaagagaguauacaaaacaccuaauaagaguagaaaauuggauauuuagaaacccagguuucgcauuggcagcagcagcaauugcgugguuacuaggaucaucaacaucacaaaaaguaauauaucuaguaaugauauuauuaauagcaccagcuuauucaauaagauguauaggcguaaguaauagagauuuuguagaaggaaugagcggaggaacauggguggauguaguauuagagcauggaggauguguaaccguaauggcacaagauaaaccaacaguugauauagaguugguuacuacaacuguuucaaauauggcagagguacguucuuacugcuaugaagcaaguaucagcgauauggcaagugacucacguugcccaacucagggggaggccuauuuagacaaacaauccgauacacaauauguuuguaaaagaacacuaguagacagaggauggggaaacggaugugguuuauuuggaaaaggcaguuuagucacuugugcaaaguucgcauguaguaaaaaaaugacagguaaaagcauccaaccagagaaccuagaauacagaauaauguuaaguguucacggaucucaacauagcggaaugauugugaacgauacuggucaugaaacggaugaaaauagagcuaaaguagaaauuacaccaaauagucccagagcagaagcaacccuaggcggauucggaucauugggacuugacugcgaaccuagaaccggacuugauuuuucugacuuguacuacuuaacaaugaauaauaaacacugguuaguucauaaagaaugguuccaugauauaccacugccauggcacgcaggagcagauacugguacaccucauuggaauaauaaagaagcauuaguugaauucaaagacgcacaugcaaaaagacaaacaguaguaguauuaggaagccaagaaggagcaguacacacagcacuagcaggagcuuuggaagcagaaauggacggugcuaaaggaagauugagcaguggacaucuaaaaugucgacuuaaaauggauaaauuaagauuaaaagguguaagcuauucacuauguacugcagcauucacauuuacgaaaauaccagcagaaacucuacacgguacaguuacaguagaaguccaauaugcaggaacagauggaccauguaaaguucccgcacaaauggcaguggacaugcaaacauuaacuccgguuggaagauuaauaacugcaaauccagugauuacggaaucgacagaaaauucaaaaaugaugcuugaauuagacccuccuuuuggagauucauacauaguaaucgguguaggugaaaaaaaaauuacacaucauuggcaucggucagguucaacuuuagggaaagcauuuucgacaacacuaaaaggcgcacaaagauuagcagcacuaggcgacacagcaugggauuucggaaguauaggaggaguuuuuaauagcauaggaagagccguacaucaaguauuuggaggagcuuuucggacucuauuuggaggcaugucauggauaacacaagguuuaaugggggcauuauuauuauggaugggaguuaaugcacgugauagaagcauagcguuagcauuuuuagcaacuggaggaguauuaguauucuuagcaacaaacguacaugca

SEQ ID NO: 9939 - RNA, 2052 nt, Artificial Sequence
  ZIKV (strain MR 766) prME-short variant CDS opt
auggacuggacauggauacuauuucuaguagccgcagcgacuagaguacauucaauuacaagaagaggaagcgcauauuauauguauuuagauaggucagaugcugggaaagcaauaucauucgcaacuacuuuggguguaaacaaaugccacguacaaauaauggaucuaggccauaugugugaugcaacaaugucauaugaauguccaauguuagacgaagguguagaaccagaugauguugauugcugguguaacacaaccucaaccugggugguuuaugguacuugucaccacaagaaaggugaagcuagaaggaguaggagggccguaacacuuccaucacauagcacaagaaaacuucaaacuagaucacaaacaugguuagaaucaagggaauacacaaaacaucuaaucaaagucgaaaauuggauauuuagaaacccaggauuugcucuaguugcaguagccauagccuggcucuuaggaucaagcacuucacagaaaguuauauauuuaguuaugauacuauuaauagcacccgcuuauuccauaagauguauaggagugaguaaucgagacuuuguagaaggaaugucaggugguacguggguggauguaguauuagaacauggaggauguguaacaguuauggcacaagacaaaccaacaguagauauagaauuagucacaacaacaguaucaaauauggcagaaguuagaucauauugcuacgaagcgucaauaagugauauggccucagauaguagauguccuacacaaggagaagcguauuuagacaaacaaucagacacacaauauguuuguaaaaggacucuaguugauagaggaugggguaauggauguggauuauucggaaaaggaucccuaguaacaugugccaaauuuacauguaguaagaaaaugaccggaaaaucuauacagccagaaaauuuagaauaucguauaauguuaagcguacaugguagucaacacagcgguaugauaggguaugaaaccgacgaagacagagcaaaaguagaaguaacaccaaacucaccaagagcugaagccaccuuaggaggauucggaagucuuggauuagauugugaaccaagaacuggauuagauuucucagaccuuuauuauuuaacuaugaauaauaaacauugguuaguacauaaagaaugguuucacgacauaccuuuaccauggcaugcaggagcagauacaggaacgccacacuggaacaauaaagaagcauuaguagaauuuaaagaugcucacgcuaaaagacaaacaguuguaguauuagggucacaagaaggugcuguacauacugcauuagcaggagcacuagaagccgaaauggacggagcaaaaggcagauuauuuaguggacaucuuaaaugcagauuaaaaauggauaaacuaagacuaaaaggaguaagcuacagccuauguacugccgcauuuacauuuacaaaaguuccagcugaaacacuacaugggacaguaacaguagaaguccaauacgcaggaacugauggaccauguaaaauaccaguacaaauggcaguagacaugcaaacacuuacaccaguugggagguuaauaacagcuaaucccguaaucacugaaucaacagaaaauaguaaaaugauguuagaacuugacccaccauuuggagauucauacauuguaauuggaguaggugauaagaaaauaacacaucauuggcauagaucuggaucaacacuuggaaaagcauucagcacaacauugaaaggagcacaaagauuagcggcauugggggauacagcaugggauuucggaaguauaggaggaguauuuaauucaauuggucgagcaguccaccaaguauuuggaggagccuuuagaacauuauucggaggaaugucauggauuacacaaggauuaaugggagcccuauugcuuuggaugggaguuaaugcacgagaccguucgauagcucucgcauuucucgcuacuggcggaguucuaguauuuuuagcaacgaauguucaugcu

SEQ ID NO: 9940 - RNA, 2064 nt, Artificial Sequence
  ZIKV (strain NatalRGN) prME-short variant CDS opt
auggauuggacauggauucuauuucuuguagcagccgcaacaaggguacauagugucacaagaaggggaagugcauauuauauguaucuagacagaaaugaugcuggugaagccauaaguuuuccaacaacgcuaggaaugaauaaauguuacauccaaauaauggaucucggccauaugugugaugcgacaaugaguuaugaaugcccaaugcucgaugaagggguagaaccagaugauguagauuguugguguaauacaacaucaacuuggguaguuuauggaacaugucaucauaaaaaaggugaagcuagaagaucgaggagagcuguaacuuuaccuucucauagcacaagaaaauuacaaacaagaagccaaacuugguuagaaagcagagaauacacaaaacauuuaauuagaguagaaaauuggauauuucgaaauccaggauucgcauuagcugcagcagcaauagcauggcuucuaggcuccaguacaucucaaaaagugaucuauuuaguaaugauacuucuaaucgcaccagcauacaguaucagaugcaucgguguaucaaauagagauuuuguugaaggaaugucgggcggaacauggguagacgucguacucgagcauggcggcuguguaacaguaauggcacaagacaaaccaacaguugauauagaauuaguuacaacuacgguaaguaauauggcagaaguuaggagcuacuguuaugaagcaucaauaucagauauggcaucagauucaaggugcccaacgcaaggagaagcauauuuagauaaacaaagugacacucaauacguauguaaaagaacauuaguugauagaggauggggaaacggaugugguuuauuuggaaaaggaagcuuaguaacaugugcaaaauuugccuguucaaaaaaaaugacaggaaaaaguauacaaccagaaaaucuagaauaccguauaaugcuaucaguacauggaagucaacacagcgggaugauaguaaacgacacaggacacgaaacagaugaaaaucgugcaaaggucgaaauuaccccaaacagcccaagagcagaagcaacucuuggagguuucggaucauuaggacuagauugcgagccaagaaccgguuuagauuuuagcgauuuauacuauuuaacaaugaauaauaaacauugguuaguucauaaagaaugguuucaugauauaccacuaccauggcaugcaggugcggauacuggaacaccucauuggaacaauaaagaagcacuaguagaauucaaagacgcacaugcuaaaagacaaacaguugucguauuaggaagucaagaaggagccguacauacugcacuagcaggugcguuagaagccgagauggauggagcaaaaggccgacuuaguagcggucauuuaaaaugcagauuaaaaauggauaaauugagacugaaaggugugucauauucacuauguacugcagcauuuacauucacaaaaauaccugcagaaacacuacacggaacugucacaguagaaguacaauacgcagguacagaugguccauguaaaguaccagcucaaauggcuguagacaugcaaacauuaacaccaguuggaagacuaauaacagcaaaucccguaauaacugaaagcacagaaaauucaaaaaugauguuggaacuugauccaccauuuggcgauaguuacauaguaauaggaguuggagaaaaaaaaauaacacaucauuggcacagaaguggaagcaccuuaggaaaagcuuuuucaacaacauuaaaaggagcacaaagauuagcagcauuaggugacacagcaugggauuuuggcucaauuggugguguauucaauaguauagggagagcaguacaucaaguuuucggcggagcauuuagaaccuuauuuggcggaaugaguuggaucacucaaggacuaaugggagcacuauuacucuggauggguguaaaugcaagagauagaagcauagccuuagcauuucuugcuacaggaggaguauuaguauuccuagcuaccaauguacaugcu

SEQ ID NO: 9941 - RNA, 2082 nt, Artificial Sequence
  ZIKV (strain ZikaSPH2015) prME-short variant CDS opt
augggcaaacguagugcaggaucgauaauguggcuagccucauuagcaguaguaauagcaugugccggagcaguaacgaggcgcggaucagcuuauuauauguaccuagacagaaaugaugcaggagaagcaauaucauucccuacaacacuuggaaugaauaaauguuauauacaaauaauggauuuaggacauaugugcgacgcaacuaugaguuacgaaugcccaaugcuugaugaaggcguagaaccagaugauguugauugcuggugcaacacaacgucaaccuggguaguguaugggacaugucaucacaagaaaggagaagcuagaagaaguagacgagcaguaacguuaccgagucauaguacgagaaaauuacaaacacgaucacaaacaugguuagaaagcagagaguacacaaaacauuuaaucagagucgaaaauuggauuuucaggaauccuggguuugcauuagcagcagcggcaauagcaugguuauuaggaucaaguacaucacaaaaaguaaucuaucuaguaaugauucuguuaaucgcucccgcauauuccauuagauguauaggaguaucaaacagagauuuuguggaaggaauguccggaggaacauggguagauauaguuuuggaacauggaggguguguaacagucauggcacaggauaaaccaacgguggauauagagcuaguaacaacaacaguaucaaauauggcagaaguaagaucuuauuguuaugaagcaucuauaagugauauggccagugacaguagauguccaacacaaggggaagcauaucuagacaaacaaagugauacacaauacguauguaaaagaacacuuguagauagaggauggggaaauggaugcggauuauucggaaaaggaucuuuaguaacaugcgcaaaauucgcaugcucaaagaaaaugacagguaaaaguauucaaccagaaaaucucgaauauagaauuauguuaaguguucauggaucacaacacagugguaugauaguaaacgauacagggcaugaaaccgaugaaaacagagcaaaaguagaaauaacaccuaauucaccuagagcagaagcuacucugggaggauucgggagucuuggacuagauugcgaaccaagaacaggucuugauuuuucugaucuauauuaucucacaaugaauaauaaacauugguuaguucacaaagaaugguuucacgacauaccguuaccauggcaugccggagcagauacgggaacuccacauuggaauaauaaagaagcucuuguagaauuuaaagaugcucaugcaaaaaggcaaacaguaguaguuuuaggcagccaagaaggagcaguacacacagcuuuagcuggagcauuagaagcagaaauggauggagcgaaaggaagacuaucgucaggucauuugaaaugcagacuuaaaauggacaaauuaagacuaaaaggaguuucauauucauuauguacugcagcauucacuuuuacaaaaauaccagcagaaacacuacauggcacaguaacuguagaaguacaauaugcuggaacagacggaccaugcaaagucccugcccaaauggcaguggauaugcaaacacuaacaccagugggaagacuaauaacagcaaauccaguaauaacagaaucaacagaaaacucaaaaaugauguuggaauuagauccaccuuuuggagacaguuauauuguaauaggcguaggagaaaagaaaauuacacaccauuggcauagaaguggaagcacacuuggaaaagccuuuagcacaacauuaaaaggagcucaaagauuagcugcacuaggagauacagcgugggauuuuggaaguauaggaggugucuuuaauaguaucggcagagcaguacaucaaguauucggaggagcauucagaacacuauuuggcggcaugucauggauuacacaagguuuaaugggagcucuauuauuauggauggguguaaacgcuagggaucggaguauugccuuagcuuuucuagcaacaggagguguguuaguauuuuuagcaacgaacgugcacgca

SEQ ID NO: 9942 - RNA, 2082 nt, Artificial Sequence
  ZIKV (isolate Z1106033) prME-short variant CDS opt
augggaaaacgaucagcaggaucuauaauguggcucgcaucauuagccguaguuauagcaugugcuggagcaguaacaagacgagguagcgcauacuauauguaucuggauagaaaugaugcgggagaagcuauaucguuuccaacaacacuagguaugaauaaauguuauauacaaauaauggauuuaggacauacaugugaugcaacaaugucauaugaauguccaaugcuagacgaaggaguugaaccagacgacguagacugcugguguaauacaacaaguacuuggguagucuauggaacgugccaucauaaaaaaggugaagcaagaaggucccgaagggcaguuaccuuacccagucauucaacuagaaaacuucagacaagaucacaaaccuggcuagaaucacgagaguauacaaaacauuuaauaagagucgaaaacuggauauuuagaaauccuggauucgcacuagccgcagcugcaauagcauggcuccuaggauccuccacaagucaaaaaguaauauauuuaguaaugauccuacucauugcaccagcauauucuauaagguguaucggaguaagcaaucgagacuuuguugagggaaugaguggcgguacauggguagauguuguacuagaacacggcggcugcguaacaguaauggcucaagauaaaccuacaguagauauagaauuaguaacuacuacaguaucuaacauggcagaaguaagaucuuacuguuaugaagccucaauaagcgauauggccucagauucaagauguccaacacaaggagaagcauacuuagauaaacaaucugauacacaauacguaugcaagagaacacuaguagauagaggaugggguaaugguuguggauuauucggaaaaggaagccuaguaacuugugcaaaauuugcauguaguaaaaaaaugacgggaaaaaguauccaaccugaaaauuuagaauauagaauaaugcuaucaguucauggcagucaacauagcggaaugauuguaaaugauacaggucaugaaaccgacgaaaacagagcaaaaguagaaauuaccccaaauaguccuagagcagaagccacuuuaggaggcuuuggaucccuaggucuugauugugaaccaagaacaggauuagauuuuucggacuuauauuaccuuacaaugaauaauaaacacuggcuaguucauaaagaaugguuccaugacauaccuuuaccuuggcaugcaggagcagacacuggcacaccacacuggaacaauaaagaagcgcucguagaauucaaagacgcccaugcaaaaagacaaacuguuguaguauugggaucacaagaaggcgcuguacauacagcauuagcaggagcucuugaagcagaaauggauggagcgaaaggaagacuaucaucggggcacuuaaaaugcagauuaaaaauggauaaguuacguuuaaaagggguuagcuacucucuuugcacagcagcauuuaccuuuacaaaaauaccagccgaaacacuacacgguaccguaacaguagaagugcaauaugcuggaacugaugguccauguaaaguaccugcacagauggcuguagauaugcaaacacuaacgccaguaggaagauuaauaacagcaaauccaguaauaacugaaucaacagaaaacucaaaaaugauguuggaacuagauccaccauuuggagauaguuauauaguaauaggaguaggagaaaaaaaaauaacucaccacuggcauagaucagguaguacguuagguaaagcauuuucgacaacauuaaaaggagcacagagauuagcugcacuuggagauacggcuugggauuucggaucaauaggaggaguauuuaauaguauuggaagagcgguacaucaaguuuuugguggagcauuuagaacccuauuuggaggaaugucuuggauuacacaaggacuuaugggagcauuauuauuauggaugggaguaaacgcucgagacagaucaaucgcauuagcauuuuuagcgacaggaggaguacuaguauuucucgcaacaaacguacacgcu

SEQ ID NO: 9943 - RNA, 2070 nt, Artificial Sequence
  ZIKV (strain MR 766) prME-short variant CDS opt
augggaaaaagaagugcaggaucaauaaugugguuagcaucacuggcgguaguuauagcaugcgcaggagcuauaacaaggaggggaucagcauacuauauguauuuagacaggagugaugcaggaaaagcaaucucauuugcaaccacacuagguguaaauaaaugucauguccaaauaauggaccuaggucauaugugugaugcuacaaugucguaugaaugcccaaugcuugacgaagguguggaaccagaugacguagauugcuggugcaacacaacaagcacauggguaguuuaugggacaugucaccauaagaaaggugaagcacgaagaucacggcgagcaguaacuuuaccaucacauucaacaaggaaacuacaaacaagaucacaaacaugguuagaaucaagagaguauacaaaacaucuaauuaaagucgaaaauuggauauuuagaaauccuggauuugcccuaguugcaguugcaauagcuuggcuucuuggaagcucaacaucccaaaaaguaauuuauuuaguaaugauacuacugaucgcuccugcauacaguauaagauguauaggaguaaguaauagagacuucguggaaggaauguccggagguacuuggguugauguaguauuagaacacgguggaugcguaacaguaauggcacaagauaaaccuacaguagacauagagcuaguaacaacaacuguaucgaauauggcugaaguuagauccuauuguuaugaagcaaguauaucggauauggcaucagacaguagauguccaacacaaggagaagcauacuuagauaaacaaagcgauacacaauauguauguaaaagaacauugguugauagaggauggggaaauggauguggauuauucggaaaaggaagucuaguaacuugugcaaaauucacguguucaaagaaaaugacaggaaaaucaauacagccggaaaaucuagaauauagaauaaugcuaucaguccauggaagccagcauucaggaaugauaggauacgaaacagaugaagauagagcaaaaguagaaguaacuccaaauucaccaagagcagaagcaacuuuaggcgguuuugguuccuuagguuuagacugcgaaccaagaacaggauuagauuuuucagauuuguacuaccuaacuaugaacaauaaacauuggcuaguucauaaagaaugguuucaugacauuccauuacccuggcaugcuggagcagacacaggaacuccacauuggaauaauaaagaagccuugguagaguuuaaagaugcacacgcaaaaaggcagacuguaguaguauuaggcucucaggaaggggcgguacacacagcauuagcaggagcauuagaagcagaaauggauggagcgaaggguagauuauuuaguggccauuuaaaguguagauuaaaaauggauaaauuaagauuaaaaggaguaucauauagucuuuguacagcagcuuucacauuuacuaaagugccagcagaaacauuacauggaacaguaacaguugaaguacaauaugcuggaacagauggaccauguaagauaccaguccagauggcaguagacaugcaaacucuaacaccagucgggagauuaauuacugcaaacccgguaauaacagaaagcacagaaaacagcaaaaugauguuagaauuagacccaccauuuggugacaguuauauaguaauagguguaggagacaagaaaauuacucaucacuggcaucgaaguggaagcacucuagguaaagcauucucuacaacacuaaaaggagcacaaaggcuagcagcacuaggugacacagcaugggacuuuggauccauaggaggaguuuuuaacucaauagguagagcugugcaucaaguauucggaggagcauuucguacuuuauucggaggaaugaguuggaucacacaaggauuaaugggagcacuauuauuauggaugggagucaaugcaagagauagaucaauagcacuagcauuuuuagcaacuggaggaguguuaguauuucuagcuacuaauguacacgcc

SEQ ID NO: 9944 - RNA, 2082 nt, Artificial Sequence
  ZIKV (strain NatalRGN) prME-short variant CDS opt
augggaaaaagaucagcaggaaguauaaugugguuagcaagucuagcaguaguaauagcaugcgcaggagcuguaacgcgaaggggaucagcauauuauauguauuuagauagaaaugacgcaggagaagcaauaucauuucccacuacauuaggaaugaacaaauguuauauacaaauaauggacuuaggacauaugugugaugcaacaaugucauacgaauguccaauguuagacgaaggcguagaaccagaugauguagauugcuggugcaauacuacaaguacauggguagucuacggaacaugucaucauaagaaaggagaagccagaagaagcagacgagcaguuacacuaccaucacauaguacgagaaaauuacaaacaagaucacaaaccuggcuagaaaguagagaauauacaaaacauuuaauaagagucgaaaauuggauauuuagaaauccaggauuugcauuagcagcggccgcaauagcauggcuacuugguucuucaacaucacaaaaaguaauauauuuaguaaugauuuuacuaaucgcaccagcauacucaauaagauguauaggcguaagcaacagagauuuuguagaagggaugaguggaggaacuuggguagauguuguauuagaacacggcgguugcgucacaguaauggcacaagacaaaccaacaguagauauagaauugguaacaacaaccguaaguaauauggcagaaguaagaucauauuguuacgaagcaucaauaagugauauggcuucagauucaagauguccuacucaaggagaggcuuacuuagacaaacaaucagacacucaauacgucuguaaaagaacacucgucgauagaggaugggguaauggaugcggacuauuuggaaaaggaucauuaguaacaugugcaaaauucgcaugcaguaagaaaaugacaggaaaaagcauacaaccggaaaaucuugaauacagaauaaugcuuucaguucauggaucacaacauaguggaaugauagucaaugauacaggucaugaaaccgaugaaaauagagcaaagguagaaauaacaccgaacaguccaagagcagaagcaacacucggaggauuuggaucauuagguuuagauugugaaccaagaacgggacuagauuuuagcgauuuauauuaccuaacuaugaauaauaaacauugguuaguacauaaagaaugguuucaugauauaccuuuacccuggcaugcaggagcagauacuggaacuccucauuggaauaauaaagaagcauuaguagaauuuaaagacgcacacgcuaaaaggcaaacaguugugguuuuaggaagucaggaaggagcaguacacacagcauuagcgggagcauuagaagccgaaauggacggagcaaaaggccgauuaucaucaggacaucuuaaauguagacuaaaaauggauaaacuaagauuaaaaggaguuucuuauucauuguguacagcagcauuuaccuuuacaaaaauaccggcugaaacuuugcacggaacggugacaguagaaguacaauaugcagguacagacgguccuuguaaaguaccagcccagauggcaguagacaugcaaacacuaacgccaguagguagauuaaucacagcaaacccaguaauaacggaaagcacagaaaauucuaaaaugauguuagaauuagauccaccuuucggagacucauauauagucauaggagugggugagaaaaagauaacacaccauuggcacagaagcggaaguacauuaggaaaagcauucucaacaacacuaaaaggagcacaacgucuagcugcauugggugauacugcaugggauuuuggcagcauagguggaguauuuaauagcauugguagagcugugcaucaaguuuucggaggagcauuccgaacauuauuuggcggaaugucauggauaacacaaggauuaaugggagcacuauuauuauggaugggaguuaaugcaagagauaggaguaucgcacuagcauucuuagcaacaggaggaguauuaguguuuuuagcaacuaauguacacgcu

SEQ ID NO: 9945 - RNA, 1785 nt, Artificial Sequence
  ZIKV (strain ZikaSPH2015) ME variant CDS opt
augacaucaguuggaauaguaggccuacuuuuaacaacagcaauggcagcaguuacauuaccaagucauaguacaagaaaacuacagacaagaagccaaacaugguuagaauccagagaguacacuaaacauuuaaucaggguagaaaauuggauauuuagaaauccaggauuugcacuagcagcagccgcaauagcauggcuauuaggaucuucuacaucacaaaaaguaauuuauuuaguaaugauacuauuaauagcaccugcuuauaguauaagguguauuggaguuucaaaucgagacuuuguugaaggaauguccgguggaacauggguagacauaguauuagaacauggcgguuguguaacuguaauggcgcaagauaaaccaacuguagauauagagcuaguaaccaccacaguaaguaauauggcagaaguuagaaguuauuguuaugaagcgucaauaagugacauggcaagugauagccgauguccaacucaaggcgaagcauauuuagacaaacaaucagauacucaauauguuugcaaaagaacauuaguagauagagguuggggaaauggcuguggauuauuugguaaaggaucauuaguaacuugcgcaaaauuugcauguucaaaaaaaaugacaggaaaaucuauacaaccagaaaaucuagaauacagaauaaugcuaaguguacacggaucccaacauucaggaaugauuguaaaugauacuggacaugaaacagaugaaaauagagcaaaaguagaaauuacaccaaacucaccucgagcagaagcaacauuaggcgguuuuggaucuuuaggauuagauugcgaaccacguacagguuuagauuucucagaucucuauuaucucaccaugaauaauaaacauuggcuaguacauaaagaaugguuucaugauauuccauuaccauggcacgcgggggcagauacaggcacuccacauuggaacaauaaagaagcauuaguagaauuuaaagacgcccaugcuaaaagacaaacaguuguaguacuaggaagccaagaaggagccguacauacagcauuagcuggggcacuagaagcagaaauggauggagcaaaaggaagauuaaguucuggucaucuaaaauguagauuaaaaauggacaaacuacgauuaaaagguguuagcuauagcuuauguacagcagcauuuacauuuacaaaaauaccugcagaaacuuuacauggaacaguaacagucgaaguacaauacgcaggaacagauggcccauguaaaguuccagcacaaauggccguagacaugcagacauuaacacccguaggaagauuaauuacugcaaauccaguaauaacggaauccacagaaaacucaaaaaugauguuagagcuugacccaccguuuggagauaguuauauagugauaggaguaggagaaaaaaaaauaacucaccauuggcacagaagugguucuacaauaggaaaagcauucgaagcaacggucagaggugcaaaaagaauggcuguauuaggagacacagcaugggacuuuggcagcguaggaggagcacuaaacucauuaggaaaaggaauacaccaaauuuucggagcggcauucaaaagucuuuuuggaggaaugucuugguuuucacaaauauuaauaggaacacuacuaaugugguuaggacuaaauacaaaaaauggaucaauaucccugaugugccuagccuuaggaggcguacuaauauuuuuauccacugcaguaucagcu

SEQ ID NO: 9946 - RNA, 1785 nt, Artificial Sequence
  ZIKV (isolate Z1106033) ME variant CDS opt
augacaagcguaggaauaguaggauuauuauuaacaacagcaauggcugcugucacccuaccaagucauaguacaagaaaacuacaaacuagaucacaaacauggcuagaaagucgagaauauaccaaacauuuaauaagaguggaaaauuggaucuuuagaaauccaggauuugcucuggcugcagcggcaauagcaugguuacuuggaucaaguacaucacaaaaaguaauauauuuaguuaugauauuacuuauagcaccagccuauaguauacguuguauaggcguuagcaauagagauuuugucgaaggaaugagcggaggaacauggguagacguaguacuagaacauggaggauguguaaccguaauggcacaagacaaaccuacgguggauauagaauuaguaacgacaacaguaucuaauauggcagagguacgaagcuacuguuaugaagcaaguauaucagauauggcaagugauagcagauguccaacacaaggagaggcauaccuagauaaacaaagugauacacaauaugugugcaaaagaacccuaguagaucgaggcuggggaaauggcugugguuuauuugguaagggaucauuaguaacaugugcaaaauuugcaugcucuaagaaaaugacaggaaaaucaauacaaccugaaaaucuugaauauagaauaauguugaguguacauggaucucaacauagcggaaugauugugaaugacacaggacacgagacagaugaaaauagagcuaaaguagaaauaacaccaaauucaccaagagcagaagcaacauuaggaggauucggaucguuagguuuagauugugaacccagaaccggauuagauuuuagcgauuuauauuaccuaacaaugaacaauaaacauugguuaguacauaaagaaugguuucaugauauucccuuaccuuggcaugcuggagcagauacaggaacaccacacuggaacaauaaagaagcauuaguagaauuuaaagaugcacacgcaaaaagacaaacugugguaguacuaggaagucaagaaggugcaguacacacagcauuagcaggagcauuagaagcagaaauggacggagcuaaaggaagauuaucuucaggacaccuaaaguguagauuaaaaauggacaaacugagacuaaaagguguaaguuauaguuuauguaccgcagcuuuuacauuuacaaaaauaccagcagaaacacuacacggaacaguaacggucgaagugcaauaugcaggaacagauggaccaugcaaagugccagcacaaauggcgguagacaugcaaacauuaacaccaguaggaagauuaauuacugcaaauccaguuauaaccgaaagcacagaaaacucaaaaaugauguuagaacuagauccaccuuuuggagauaguuauauaguaauaggaguaggugaaaagaaaaucacacaccauuggcauagaaguggcucaacaauaggaaaagcauucgaagcaacaguaagaggggcaaaaagaauggcuguacuaggagauacagcaugggauuuuggaucagucggaggagcauuaaacagcuugggaaaaggaauacaucaaauauuuggagcugcauuuaagaguuuauucggcggaaugaguugguuuagucaaauauuaauaggaacuuuacucaugugguuaggguuaaaugccaaaaauggcucgauuagucuaauguguuuagcuuuaggaggaguauuaauauuucuaagcacagcggucucagcu

SEQ ID NO: 9947 - RNA, 1773 nt, Artificial Sequence
  ZIKV (strain MR 766) ME variant CDS opt
augacaaguauaggaauaauaggacuacuauuaacaacagccauggcagcaguaacacuaccuucacacucgaccaggaaacuacaaacccgaagucaaaccugguuagaaaguagagaauacacuaaacaucuaauaaaaguugaaaauuggauauuuagaaauccaggauuugcuuugguugcaguugcuauagcauggcuauuaggaagcagcacaucucaaaaaguuauuuaucuaguuaugauacucuuaauagcuccugcauauaguauacgcuguauaggaguaucaaauagagauuuuguagaaggaaugucaggaggcacauggguagauguuguacuagaacacgguggauguguaacaguaauggcacaagauaaaccaacgguagacauagaauuaguaacaacaaccguaaguaauauggcagaaguacgaucauacugcuaugaagcaucaauaagcgacauggcaagugauucuagaugcccaacacaaggugaagcauaucuagauaaacaaucugacacgcaguauguauguaaacgcacgcuaguagauagaggaugggguaacgguuguggucuauuugguaaaggaucucuuguaacaugcgcaaaauucacauguucuaagaaaaugacaggaaaaagcauucagccagaaaaucuagaauacagaauaaugcuaucuguucauggaucucaacauuccgguaugauaggauaugaaacugaugaagauagagcuaaaguagaaguaacaccaaauaguccaagagcugaagcaacacuaggaggcuucgguaguuuaggguuagauugugaaccgagaacaggacuugacuuuagugaccuauauuaucuuacaaugaacaauaaacauugguuaguccauaaagaaugguuccacgauauaccacuaccauggcaugcuggugcagauacaggaacaccacacuggaauaauaaagaagcucuaguagaguucaaagaugcacaugcaaaaagacaaacaguaguaguacuaggaagucaagaaggggcaguacauacagcauuagcaggagcauuagaagcagaaauggacggagcaaaaggacgucucuucuccggacaccuaaaaugcaggcuaaaaauggacaaauuaagguuaaaaggaguaucuuauucacuuuguacagccgcauucacauuuacaaaaguaccagcagaaacacuacauggaacuguaacaguugaaguucaauaugcuggaacagauggaccauguaaaauaccuguacaaauggcaguagauaugcaaacuuuaacaccaguagguagauuaauaacagcaaacccuguuauaacagaaaguacagaaaacagcaaaaugaugcuagaacuagacccuccauucggagacucuuacauaguaauuggaguaggagacaagaaaauaacacaucauuggcaccgaucuggcucaacaauaggaaaagcauuugaagcaacaguaagaggagcaaaaagaauggcaguauuaggagauacugccugggauuuuggaucaguaggaggaguauucaauagcuuaggcaaaggcauacaucaaauauuuggugcugcauucaaaaguuuauuugggggaaugucaugguuuucacaaauucuaauaggaacacuauuaguauggcuaggauuaaacacgaaaaauggaagcauuagucuaacaugucuagcucuagguggaguaaugauauuccuaucaacagcaguaucagca

SEQ ID NO: 9948 - RNA, 1785 nt, Artificial Sequence
  ZIKV (strain NatalRGN) ME variant CDS opt
augacaucaguaggaauagucggauuauuauuaacaacagcaauggccgcaguaacauuaccaagccauaguacuagaaaauuacaaacacgaagccaaacaugguuggaaucaagagaauacacaaaacaucuuauaagaguggaaaauuggauauucagaaauccaggauuugcacuagcagcagcagcuauagcauggcuucuaggcaguaguacaucacaaaaagucauuuauuuaguaaugauauuacuuauagcuccagcauauucuauucguuguauaggaguaucaaacagagacuuuguugaaggaaugaguggaggaacuuggguagauguaguuuuagaacaugguggauguguaacaguaauggcacaagauaaaccuacaguagauauagagcuaguuacaacaacgguaucaaauauggccgaaguaaggaguuauuguuaugaagcaucaauaucagauauggcaucagauaguagauguccaacacagggcgaagccuaucuagauaaacaaucagacacacaauauguauguaaaaggacacugguggauagaggauggggcaacggauguggcuuauuuggaaaagguaguuuagucacaugugcaaaauuugcauguucuaagaaaaugacagguaaaucuauccaaccagaaaaucuagaauauagaauaaugcuuagcguucauggaagucaacacagugguaugauugugaaugauacuggacaugaaacagacgaaaauagagcaaaaguagaaauaacaccaaacucacccagagcugaagcaacacuaggaggauucggaucacuuggacuagauugugaaccuagaacuggacuugauuucagugauuuauacuacuuaacuaugaauaauaaacauugguuaguacauaaagaaugguuccacgacauuccacuaccuuggcaugcuggugcagauacaggaacgccacauuggaauaauaaagaagcacucguagaguucaaagaugcacaugcaaaacgacaaacgguaguuguauuaggaagucaagaaggcgcaguccauacagcauuagcuggagcacuagaagcugaaauggauggagcaaaagguagauuaaguuccggacaccuaaaauguagacuaaaaauggauaaauuaagacugaaagguguaagcuauagucugugcaccgcugcauuuacauucacaaaaauaccugcugaaacauuacauggaacaguaacaguugaaguacaauaugcaggaacagacggaccuugcaaaguacccgcacagauggcuguagacaugcaaacauuaaccccagugggaagacuaauaacagcaaauccaguaauaacagaaagcacugaaaauucaaaaaugauguuagaacucgauccaccauuuggggauagcuauauaguaauaggaguaggcgaaaagaaaauaacacaccacuggcauagaagugguaguaccauuggaaaagcauuugaagcuacagucagaggagcaaaaagaauggcaguacuuggcgauacagcuugggauuuugguucuguaggcggagcuuuaaacaguuuaggaaaaggaauacaucaaaucuuuggagcagccuuuaaaaguuuauuuggaggaaugaguugguuuucccaaauuuuaauaggaaccuuauuaauguggcuagguuuaaauacgaaaaaugggagcaucagcuuaaugugucuagcacuuggugggguauuaauauuucuaagcacagcgguaucugca

SEQ ID NO: 9949 - RNA, 1812 nt, Artificial Sequence
  ZIKV (strain ZikaSPH2015) ME variant CDS opt
auggccauaagcggaguaccaguauuaggauucuucauaaucgcaguacuaaugagugcacaagaaaguugggcagcagugacauuaccaagucacaguacaagaaaauuacaaacacguagucaaacaugguuagaaagucgagaauauacaaaacaucuaauacguguagaaaacuggauauuuagaaauccaggauuugcuuuggcagcagcugccauagcauggcuucuaggaagcucaacaucacaaaaaguuauauaucuagucaugauucuucuaaucgccccugcauauucaauaagauguauaggagucucaaacagagauuucguagaaggaaugucaggaggaacauggguagacauaguccuugaacacggaggauguguaacuguuauggcccaagauaaaccuacuguagauauagaauuggucacaacuacaguaagcaacauggcagaaguaagaucauauuguuaugaagcuagcauaucagauauggcaucagauucaagaugcccaacacaaggugaagcauaucuagauaaacaaucagauacacaauacguauguaaacgaacauuaguagauagaggauggggaaauggauguggacuuuuuggaaaaggaucauuaguaacaugcgccaaauuugcguguucaaagaaaaugacuggaaaaucaauacaaccggaaaaccuagaauauagaauaauguuaaguguucauggaucacaacauucagguaugauaguuaaugauacaggacaugaaacagaugaaaacagagcaaaaguagaaauaacaccaaauucaccaagagcagaagcaacauuaggcgguuucggaaguuuaggacuugauugugaaccuagaacagguuuagauuuuucagaccuauauuauuugacaaugaauaacaaacacugguuaguacacaaagaaugguuccaugauauaccacuaccauggcaugcuggugcggauacaggaacuccccauuggaauaauaaagaagcguuaguagaauuuaaagacgcacacgcaaaaagacaaacuguaguaguauugggaucucaagaaggagcaguacacacugcauuagcaggagcacuagaagcagaaauggauggagcuaaaggcagacuuagcaguggacauuuaaaaugucguuuaaaaauggacaaauuaagauuaaaagggguauccuacucccuaugcacagcugcuuuuacuuucacaaaaauuccugcagaaacacuucauggaaccguaacaguagaaguacaauacgcgggaacagaugggcccugcaaaguacccgcacaaauggcaguagauaugcaaacauuaacaccuguaggcagauugauaacugcuaauccaguaauaacagaaucaacagaaaauaguaaaaugaugcuagaauuagacccaccauuuggcgauaguuauauagucauuggaguuggggagaagaaaauaacucaucacuggcacagaucaggaaguacuauaggaaaagcauucgaagcaacagugagaggagcaaaaagaauggcaguauuaggugauacagcuugggauuuuggaucaguaggaggagcacuaaacucucuagguaaaggaauccaucaaauuuuuggugcagccuuuaaaucauuauuuggaggaaugucaugguucagucaaauauuaauagguacauuauuaauguggcugggacuaaauacuaaaaacgguaguauaagccuaaugugucuagcacucggugguguacuaauauucuuaaguacagcagucucagca

SEQ ID NO: 9950 - RNA, 1812 nt, Artificial Sequence
  ZIKV (isolate Z1106033) ME variant CDS opt
auggcgauaaguggaguaccaguguuaggauuuuuuauaauagcaguacuaaugucugcucaagaaucaugggcagcagucacauuaccaucacacucaacuaggaaauuacagacccgaucgcaaaccuggcuggaaucaagagaauauacaaaacacuuaauaagaguagaaaauuggauauuuagaaaucccggauucgcacuagcagcggcugcaauugcuugguuacuuggauccaguacaucccaaaaaguaauauauuuaguaaugauacuucuuaucgcaccagccuauaguauuagauguauuggaguaucaaauagagauuuuguagaaggaaugucaggagguacuuggguugaugugguacuagaacacggcggaugugucacaguaauggcacaagauaaacccacaguagauauagaauuaguaacgacaacagugucaaauauggcagaaguaagaucauauugcuacgaagcaaguauaagugacauggcaucagauucacgauguccaacacaaggagaagcauauuuagauaaacaaucagacacacaauauguauguaaaagaacauuagucgauagggguuggggaaacggaugcggcuuauuuggaaaaggauccuuaguaaccugugcaaaauucgcauguucgaaaaagaugacaggaaaaucuauacaaccagaaaauuuagaauauagaauaaugcuaucaguacacggaucucaacauucagguaugauaguaaaugauacuggacaugaaacagacgagaacagagcaaaaguagaaauaacuccaaauagcccacgugcggaggccacacuaggaggauuuggaagccuggggcuagacugugaaccuagaacaggacuagauuucucagaccuauauuauuuaacaaugaauaacaaacauugguuaguccacaaagaaugguuucaugauaucccacuaccauggcacgcaggugcagauacggguacaccacauuggaauaacaaagaagcauuagucgaauuuaaagaugcccaugcaaaaagacaaacaguaguaguacuagguucacaagaaggagcugugcauacagcacuagcuggugcauuagaagcagaaauggauggagcaaaaggaagauuaucaagcggacauuugaaaugucgacuaaaaauggauaaacuuaggcuuaaagguguaagcuacucuuuauguaccgcagcauucacguucacaaaaauaccagccgaaacauuacacgguacuguaacaguagaaguacaauacgcagguacagauggaccauguaaaguaccagcucaaauggcaguagacaugcaaacuuuaacaccaguagggagauuaauaacagcgaauccaguaauuacagaauccacagaaaacaguaaaaugaugcuagaauuagauccacccuuuggagacucauauaucguaauagguguaggugaaaaaaaaauaacacaucacuggcaucgaucuggaucaaccauaggaaaagcauuugaagcuacaguaagaggagcgaaaaggauggcaguuuuaggagacacugcaugggauuuugguaguguaggaggagcauuaaauucauuggguaaaggcauacaucaaauauucggagcagcauuuaaaagcuuauuuggaggaaugaguugguuuucacaaauacuaauaggaacuuuacuuaugugguuaggucuaaaugcuaaaaauggcucaauaucacuaauguguuuagcacuagguggaguacuaauauuuuuaaguacagcuguaucagca

SEQ ID NO: 9951 - RNA, 1800 nt, Artificial Sequence
  ZIKV (strain MR 766) ME variant CDS opt
auggcaauaucagguguaccagucuuagguuucuuuauaauagcaguauuaaugucagcacaagaaagcugggccgcaguaacucuacccagucacucgacaaggaaacuacaaaccagaucacaaacaugguuagaaaguagagaauauacaaaacaccuuauuaaaguagaaaauuggauauuuagaaauccuggguucgcguuagucgcaguagcaauagcauggcuauuaggaagcagcacaagucaaaaaguaauauaccuaguaaugauauuacuaaucgcgccagcauauaguauacguuguauaggaguuucaaacagagacuuuguagaaggaaugucaggagguacauggguagaugucguauuagaacauggaggaugugucacaguuauggcucaagauaaaccaacaguagauaucgaauuaguaacaacuacugucaguaauauggccgagguuagaucauacuguuacgaagcaucaauaucagauauggcaagugauaguagaugcccaacacaaggagaagcauauuuagacaaacaaucagauacucaauacguauguaaacgaacacuaguagacagagguuggggaaacggauguggauuauuuggaaaaggaaguuuaguaacaugugcaaaauuuacuugcucaaaaaaaaugacuggaaaaucaauucaaccggaaaaucuagaauaucgaauaaugcuaaguguacauggaagccaacauucaggaaugauuggcuaugaaacugaugaagacagagcuaaaguugaagugacaccaaacucaccuagagcagaagcaacauuaggagguuucgguucauuaggauuagauugcgaaccacgaacagguuuagauuucagugaucuauauuauuuaacaaugaacaauaaacauuggcuaguacauaaagaaugguuccaugauauaccacucccauggcaugcgggugcagacacaggcacuccacacuggaacaauaaagaagcuuuaguagaauuuaaagaugcacacgcaaaaagacagacaguaguuguacuaggaucacaagaaggagcaguacacaccgcacuugcaggcgcauuagaagcggaaauggacggagccaaagguagauuauuuaguggacauuuaaaauguagauuaaaaauggauaaauuaagacuaaaaggaguaagcuacucauuaugcacagcagccuuuacauuuacaaaaguacccgcugaaacauugcacggaacaguuacaguugaaguucaauacgcaggaacagauggaccauguaaaauaccaguacaaauggcagucgacaugcaaacauuaacaccaguaggucgacuaauaacagcaaaccccguuauaaccgaaucuacugaaaacucgaaaaugaugcuagaacuagacccaccguuuggagauucauauauaguaauaggcguaggagauaaaaaaauaacacaucauuggcacagauccggaagcacaauaggaaaagcauuugaagcuacaguaagaggagcuaaaagaauggcaguauuaggagauacagcaugggacuuuggaaguguaggagguguauuuaacaguuuaggaaaaggaauacaucaaauauuuggcgcagccuuuaaaagccuauucggaggaaugagcugguuuucacaaauucuaaucggaacucuacuaguguggcuaggacuuaauacaaaaaaugguagcauaaguuuaacaugucuagcauuaggagguguuaugauauuucuaucaacagcgguaagugca

SEQ ID NO: 9952 - RNA, 1812 nt, Artificial Sequence
  ZIKV (strain NatalRGN) ME variant CDS opt
auggcaauuucuggaguuccaguauuagguuuuuuuauuauagcgguacuaaugagugcacaagaaagcugggcagcaguaacauuaccuagucauaguacuagaaaacuacaaacaagaucacaaacaugguuagaaucgcgagaauauaccaaacauuuaauaagaguagagaacuggauuuucagaaauccaggcuucgcccuagcagcagcagcaauagcaugguuauuaggaaguucaacaucacaaaaaguuauauaucuagucaugauauuauugauagcgcccgcauauucaauacgauguaucggaguaucaaauagagauuuuguagaaggaaugucuggaggaacuuggguagacgucguacuagaacacgggggauguguaacaguaauggcucaagauaaaccuacaguagauauagaauuaguaacgacaacaguaagcaacauggcagaagucagauccuauuguuaugaagccaguauuagcgacauggcgagcgauagcagauguccaacacaaggggaagcuuauuuagauaaacaaucagacacacaauacguauguaaaagaacauuaguagauagagguuggggaaaugguuguggacuuuuuggaaaaggaaguuuaguaacaugugcaaaauuugcaugcucuaaaaaaaugacaggcaaaucaauacaaccagagaaccucgaauauagaauaauguuaagcguacauggaagucaacauagcgguaugauaguaaaugacaccggacacgaaacagacgaaaauagagcaaaaguagaaauaacgccaaauaguccgcgcgcagaagcaacauuaggaggauucggaucacuaggauuagacugugaaccaagaacaggacuugauuuuucugaucuauacuaucuuacaaugaauaauaaacauugguuaguucauaaagaaugguuccaugauauuccuuuaccauggcacgcaggugcagauacaggaacaccacauuggaauaauaaagaagcauuaguagaauucaaagaugcucaugcuaaacgucaaacuguaguuguauuaggaagccaagaaggagcaguucauacugcauuagcaggagcauuagaagcugaaauggauggugcaaaagguagauugaguaguggacauuuaaaauguagacuaaaaauggacaaauuacgacuaaaaggaguuucauauagucuauguacugcugcauuuacauucacaaaaauaccagcugaaacauuacacggaaccguuacaguugaaguacaauacgcaggcacagauggaccaugcaaaguuccagcacaaauggcaguagacaugcaaacauuaacaccaguaggaagacuaauuacagcaaauccuguaauaacagaaucaacugaaaauagcaaaaugauguuagaauuagauccaccauuuggagauucauauauugugauaggaguaggagaaaaaaaaauuacacaccacuggcauagaucugggucaacaauagguaaagcauucgaagcuacuguaagaggagcaaaaagaauggcaguacuuggagauaccgccugggauuucgguaguguaggaggagcacuaaacucacuuggaaaaggcauacaucaaauauuuggagcagcauuuaaaucacuauuugguggaaugucaugguuuucacagaucuuaauagguacacuacuaauguggcuaggacuuaauacaaaaaauggaucaauaucauuaauguguuuagcauuaggaggaguuuuaauuuuuuuaagcacagcaguaagugca

SEQ ID NO: 9953 - RNA, 1791 nt, Artificial Sequence
  ZIKV (strain ZikaSPH2015) ME variant CDS opt
auggauuggacauggauauuauucuuaguugcagcugcaacaagaguacauagugcaguaacauugccgucacacucaacaaggaaauuacaaacaagaagccaaacaugguuagaaagccgagaauacacaaaacauuuaauuagaguagaaaacuggauauuuagaaauccaggauuugcucuagcggcagcagcaauagcaugguuacuuggaucaucaacaagccagaaaguaauauacuuaguaaugauacuucuuauagcuccagcauacucaauacgauguauuggaguaagcaauagagauuuugucgaaggaaugucaggaggaacaugggucgacaucguauuagaacaugguggauguguuacaguaauggcacaagauaaaccuacuguagauauagaacucguaacuacaacuguaucaaacauggcagaaguaagaucauacugcuaugaagcaucaauaagugauauggcaucggauaguagauguccuacacaaggagaagcauauuuagauaaacaaucagauacacaauacguauguaaacguacuuuaguagauagagguuggggaaauggaugcggauuauuuggaaaagguaguuuaguaacaugugcaaaauuugcuuguucaaagaaaaugacagguaaaaguauacaaccagaaaauuuggaauauagaauaauguuaucuguacauggaagccaacauaguggaaugauuguaaaugauacaggacaugagaccgaugaaaauagagcaaaaguagaaauaacuccaaauucaccacgagcagaagcgacauuaggaggauucgguucauuagguuuagauugugaaccaagaacagggcuagauuuuucugaucuauauuaucuaacuaugaacaauaaacauuggcuaguacauaaagagugguuucaugacauaccauuaccauggcaugcuggagcagauacaggaacaccacauuggaacaauaaagaggcuuugguugaauuuaaagacgcccacgcaaaaagacagacaguagucguuuuaggcagucaagaaggagcaguucacacagcauuagcuggagcauuagaagccgaaauggacggagcaaaaggucgauuaucaaguggacaccuaaaauguagauuaaaaauggacaaacuacgacuuaaagggguuucauauucacuauguacagcagccuuuaccuuuacaaaaauaccagcagaaacuuuacaugguacaguaacagucgaaguccaauaugcagguacagauggcccauguaaagucccggcacaaauggcaguagauaugcagacacuaaccccaguaggaagacuuauaacagcaaauccaguuauaacagaaucuacugaaaauucaaaaaugauguuagaguuagauccuccauuuggagauagcuauaucguaauaggagucggagaaaagaaaauaacacaucauuggcauagaaguggaaguaccauaggaaaagcauuugaagcaacaguaagaggagccaaaagaauggcaguacuuggagauacggcaugggauuuuggcagcguaggaggugcauugaauaguuuaggaaaaggaauacaucaaaucuuuggugccgcauucaaauccuuauuuggaggaaugagcugguuuucacaaauacuaaucggaacauuacuaaugugguuaggauuaaauacuaaaaauggaagcauaaguuuaaugugccuggcacuaggaggaguacuaauauuuuuaaguacagcagugagcgcu

SEQ ID NO: 9954 - RNA, 1791 nt, Artificial Sequence
  ZIKV (isolate Z1106033) ME variant CDS opt
auggauuggacauggauauuauucuuaguagcugcagcaacccgaguacacucagcagucacauuacccagucauagcacaaggaaauuacaaaccagaucacaaacuugguuagaaucaagagaauacacaaaacaucucauaagaguugaaaacuggauauuuagaaaccccggcuuugcucuagcagcagcagcaauugcauggcuacuaggaagcucuacaucacaaaagguaauauauuuaguaaugauacuauuaauagcaccagcuuacaguauuagauguauaggaguuucgaauagagacuuuguagaaggaaugucaggagguacauggguagauguaguacuagaacauggcggaugugugacaguuauggcacaagauaaaccaaccguagauauagaauuagugacgacaacaguaucaaauauggccgaaguaagaucuuauuguuaugaagcauccauuucugacauggccucagauaguagaugccccacucaaggagaagcauacuuagauaaacagucagacacucaauacguuuguaaaagaacucuaguagauagagguugggguaauggauguggauuauuuggaaaaggaagccuaguaacaugcgcaaaauuugcauguaguaaaaagaugacuggaaaaucaauacaaccagaaaaccuugaauaucgaauuauguugucaguccacggaagucaacauaguggaaugauaguaaaugacacaggacacgaaacagacgaaaauagagcuaaaguagaaauaacaccaaauucuccgagagcugaagcaacacuuggaggauuugguagcuuagguuuagacugugaaccaaggacuggauuggacuuuucagaucuauauuauuuaacaaugaauaauaaacacuggcuaguacacaaagaaugguuucacgauauuccauuaccauggcaugcaggagcugacacagguacaccacauuggaauaauaaagaagcauuaguagaguucaaagaugcacacgcgaaaagacaaacaguaguagugcuagguucacaagaaggagcaguacauaccgcauuagcaggagcauuagaagcagaaauggauggagcaaaagggagacuaucaaguggacauuuaaaauguagauugaagauggauaaauuaagauugaaagggguaucuuacaguuuauguacugcagcuuucacauuuacaaaaauaccagcagaaacacuacauggaacaguaacaguugaaguacaauacgcaggaacagauggacccugcaaaguuccagcucaaauggcaguagauaugcaaacucuaacgccaguaggacgguuaauaacagccaauccagugauuacagaaucgacagaaaacucaaaaaugaugcucgaauuagauccacccuuuggagauucauauauuguuauaggaguaggagaaaagaaaauaacacaucauuggcauaggagcggcucaacuauaggaaaagcauucgaagcaacaguaagaggagcuaaacgaauggcaguauuaggagauacagcuugggacuucggaagcguuggaggagcccuaaauaguuuaggaaaaggaauacaucaaauauucggagcagcauuuaaaucauuauuuggaggaaugaguugguucucacaaauucuuauuggaacccuauuaauguggcuaggcuugaaugcuaaaaauggaaguauaagucucaugugcuuagcacuaggagggguauuaauauuuuuauccaccgcaguuucagca

SEQ ID NO: 9955 - RNA, 1779 nt, Artificial Sequence
  ZIKV (strain MR 766) ME variant CDS opt
auggauuggacauggauauuauuuuuagucgcagcagcaacuagaguacauucugcaguuacuuuaccaagucauucaacaaggaaacuacaaacaagaucacaaacauggcuagaaucaagagaauacacuaaacaucuaauaaaaguagaaaauuggauauuuagaaaucccggcuuugcacucguggcaguagcaauagcaugguuguuagggagcucuaccagucaaaaaguuauuuaucuuguaaugauacuacuaauagcaccagcauauagcauaagauguauaggaguuagcaacagagacuuuguggaaggaaugucaggaggaacauggguagaugucguacuagaacauggcggauguguaacaguaauggcacaagauaaaccaacaguagauauagaacuaguaacaacaacuguaucuaauauggcagaaguaagaucauacuguuaugaagcaagcauuucugauauggcaucagauagcagaugcccaacacaaggagaagcauaucuagauaaacaaagugauacacaauacguaugcaaaagaacauuaguugacagaggaugggggaaugguugcggucuguuuggaaaaggaaguuuaguuacaugugcuaaauuuacaugcaguaaaaaaaugacuggaaaaagcauucaaccagaaaauuuagaauaccgaauaauguuaagcguacauggaagccaacacucaggaaugauaggauaugaaacagaugaagauagagcuaaaguagaagucacaccgaauucaccaagagcugaagcaacucuaggagguuuugguucacuugguuuagauugugaaccaagaacaggacuagacuucucagauuuguauuaccuaacaaugaauaauaaacauuggcuaguucauaaagaaugguuucacgacauaccauugccuuggcacgcaggagccgauacuggaacaccacauuggaauaauaaagaagcacucguagaauuuaaagaugcacaugccaaaagacaaacuguagucguacuaggaagucaagaaggggccguacauacugcauuagcaggcgcacuagaagcugaaauggauggcgcaaaagguagacuauucagcggacaccuaaaaugucgauuaaaaauggauaaauuaagauuaaagggaguaagcuauucuuuauguacagccgcuuuuacauucacuaaaguaccagcagaaacauuacacgguacaguaaccguagaaguccaauacgcaggaacagauggaccaugcaaaauuccaguacaaauggcaguagauaugcaaacguuaacaccaguaggucgauuaauuacagcaaauccaguaaucacagaaucaacagaaaauucgaaaaugaugcucgaacuagacccuccauucggagauaguuauauaguaaucggaguaggagauaaaaaaauaacacaccacuggcauagaaguggcucaacaauagggaaagcauuugaagcaacaguaagaggagcaaaaagaauggcaguuuuaggugacacugcaugggacuuugguaguguaggagguguauuuaauagcuuaggaaaaggaauccaucaaauauuuggagcagcauucaaaucauuauucggugguaugucaugguucucacaaauucuaauagguacacuucuuguuugguuaggucuaaauacaaaaaauggaucaauuucucuaacauguuuagcuuuaggaggggucaugaucuucuuaucuacggcaguaucagcu

SEQ ID NO: 9956 - RNA, 1791 nt, Artificial Sequence
  ZIKV (strain NatalRGN) ME variant CDS opt
auggacuggacauggauucuauuucucguagcagcagcaacaagaguucauucagcaguaacauuaccaucacauucaacaagaaaacuacaaacaagaagucaaacauggcuagaaucgagagaauauacaaagcauuuaaucagaguagaaaacuggauauuuagaaacccuggauuugcauuggccgcugcugcaauagcaugguuacuuggaagcagcacaagucaaaaaguaauauaucuaguaaugauacuauuaauagccccagcauauucaauuagauguauaggagucucaaauagggauuucguagaaggaaugaguggaggaacauggguagacguaguacuagaacacggugggugcguaacaguaauggcacaagacaaacccacaguagauauagaauuagugacaacuacaguuaguaacauggcagaaguuagaaguuauuguuacgaagcaagcauaagugauauggcaagcgauucucgauguccgacucagggagaagcauaucuagacaaacaaucugauacacaauauguguguaaacgaacucuagucgauagaggguggggaaauggauguggacucuuuggaaaaggaagucuaguaacgugcgcuaaauuugccuguaguaagaaaaugacgggaaaauccauacaacccgaaaacuuagaauauagaauaauguuaagugugcauggaagucaacauaguggaaugauaguaaacgauacaggacacgaaacagaugaaaauagagcaaaaguagaaauaacacccaauagccccagagcagaagcaacacuaggagguuuuggaucauuaggacucgauugugaaccuagaacuggguuagauuuuucagauuuauauuauuuaacaaugaauaauaaacauugguuaguucauaaagaaugguuucaugauauaccuuuaccauggcaugcuggggcagacacaggaacaccacauuggaauaacaaagaagcauuaguagaauuuaaagacgcacaugcuaaaagacaaacugugguagugcuagggagucaagaaggggcaguacauacagcauuagccggagcuuuagaagcagaaauggauggagcaaaaggaagauuauccagcggacaucuaaaauguagauuaaaaauggauaaauuacguuuaaaaggugugagcuacucacuuuguacagcugcauuuacauucacaaaaauuccagcagaaacccuacacggaacagucacagucgaaguacaauacgcaggaacagacggaccuugcaaaguacccgcucaaauggcagucgauaugcaaacauuaacaccuguagguagacuaauuacagcaaauccaguaauaacagaaucaacagaaaauaguaaaaugaugcucgaauuagauccaccauuuggugauucauauauaguuauaggaguaggagagaaaaagauuacacaucauuggcauagaaguggaaguacaauaggaaaagcauuugaagcaacaguaagaggagcaaaacgaauggcaguauuaggagauacagcuugggacuuuggaaguguuggaggugcacuaaauaguuuaggaaaaggaauacaucaaauauuuggagcagcauuuaaaucauuauuuggugguaugucgugguuuucccaaaucuuaauaggaacuuuauuaauguggcuaggauuaaauacgaaaaauggaucaauaucacucaugugucuagcauuaggaggaguuuuaaucuuuuuaucaaccgcaguuucagca

SEQ ID NO: 9957 - RNA, 1809 nt, Artificial Sequence
  ZIKV (strain ZikaSPH2015) ME variant CDS opt
augggaaaaagguccgcaggaaguauaaugugguuagcuagcuuagcaguagugauagcaugugcaggagcugcaguaacauuaccaucacauuccacaagaaaacuacaaacaagaucucaaacaugguuagaaucaagagaauacacaaaacaccuaauacgaguagaaaacuggauauuuagaaauccuggauucgcacuagccgcagcagcaauugccugguuauuaggaaguaguacaagccaaaaaguaauauauuuaguaaugauauuauuaauugcaccagcauauaguauaagauguauaggaguaaguaauagagauuuuguagaaggaaugaguggagguacauggguagauauaguauuagaacacggaggauguguaacaguuauggcucaagauaaaccuacaguugauauugaauuaguaaccacuacaguaucaaauauggcugaaguaagaaguuauuguuaugaagcaaguauuagcgauauggcgagugauagcagaugucccacacaaggugaagcauacuuagauaaacaaagugacacacaauauguaugcaaaagaacucuaguagauagaggauggggaaacgguugcggauuauuuggcaaagguagcuuagucacaugugcaaaauuugccugcaguaagaaaaugacaggaaaaaguauacaaccagaaaauuuagaauauagaauaaugcuuagcgugcacggaucacaacauucaggaaugauagugaaugauacaggacaugaaacagacgaaaauagggcaaaaguugaaauuacgccaaauagucccagggcagaagcaaccuugggaggauuuggcaguuuaggacuagauugugaaccaagaaccggauuagauuucucugaucuauauuauuuaacgaugaauaauaaacacugguuaguacacaaagaaugguuucaugauauaccauuaccguggcacgcaggagcagauacaggaacaccucauuggaauaauaaagaagcucuaguagaauuuaaagacgcccacgcgaaaagacaaacagucguaguauuagguagccaggaaggagccguucacacagcauuagccggugcuuuagaagcagaaauggauggagcaaaagguagacuaagcaguggacacuuaaaauguagguuaaaaauggacaaauuaagacuaaaagguguaucauauaguuuauguacagcggcauuuacguucacaaaaauucccgcagaaacauuacacggaacaguaacaguagaaguacaauaugcaggaaccgauggaccauguaaaguaccagcacaaauggcaguagauaugcaaacauuaacaccuguaggaagacuuaucacagcaaauccuguuauaacagaaagcacagaaaauucaaaaaugauguuagaauuagacccaccauucggugauaguuacauaguaauaggaguaggcgagaagaaaauuacacaucauuggcauagaucaggauccacaauagguaaagcguucgaagcaacagugagaggagcaaaaagaauggcaguauuaggggauacugccugggauuuuggaucaguagggggagcauuaaauagucuaggaaaagguauacaccaaauuuuuggagcggcuuuuaaaucucuauuuggugggaugucaugguuuucacaaauacuaauaggcacacuacucauguggcuaggauuaaacacgaaaaauggaagcauaucauuaaugugucuagcacuaggagguguccuaauauuccugucaacagcaguaagugca

SEQ ID NO: 9958 - RNA, 1809 nt, Artificial Sequence
  ZIKV (isolate Z1106033) ME variant CDS opt
augggaaaaaggagcgcaggaucaaucaugugguuagcaucauuagcaguaguaauugccugcgcuggugcagcaguaacauugccaagucauucuacaagaaaacuacagacaagaagccaaacauggcuagaaucuagagaauacacaaaacauuuaauaagaguugaaaacuggauauuuagaaauccaggauuugcacuagcagcagcagcaauagccugguuauuaggaaguucaacaagucaaaaaguaauuuacuuaguaaugauacuauuaauagcuccagcauauaguauaagauguauaggaguaucaaauagagauuuuguugaagguaugaguggaggaacauggguagauguuguacuagaacauggaggauguguaacuguaauggcacaagauaaaccaacagucgacauugaacuaguaacaacuacagugucuaacauggcugaaguaagaucauauugcuaugaagcaucuauaagugauauggcaucagauagcagauguccuacucaaggagaagcauaucuugauaaacaaucagauacacaauauguauguaaaagaacauuaguagauagaggauggggaaaugguuguggcuuauuuggaaaaggaagucuaguaacaugugcaaaauuugcaugcaguaaaaaaaugacgggaaaaaguauacagccagaaaaccuagaauacagaauuauguuaagcguucaugguagucaacauaguggaaugauaguaaacgauacugggcaugaaacugacgagaauagagccaaaguagaaauaacaccaaauucaccgagagcagaagcuacacuugguggauucggaucacuuggucuagauugcgaaccaagaacaggacuugacuucucagaccuauauuaucuaacaaugaauaauaaacauugguuaguucauaaagaaugguuucaugauauaccauuaccauggcaugcaggagcagauacgggaacaccacauuggaauaauaaagaagcacuagucgaauuuaaagaugcacaugcaaaaagacaaacgguaguuguacuaggaucacaagaaggagcaguacauacagcauuagcuggggcuuuggaagcagaaauggauggcgcgaaaggaagacuaucaaguggacauuuaaaaugccgauugaaaauggauaaauuaagauuaaaaggaguaaguuacucauuauguaccgcugcguuuacauuuacgaaaauuccagcagaaacguuacauggaacaguaacagucgaaguucaauaugcaggaacagacggaccauguaaagugccagcacaaauggcaguagacaugcaaacauuaacaccagugggaagauuaauaacagcaaacccaguaauaacagaaucuacggaaaauagcaaaaugauguuagaacuagacccacccuucggagauucauauauuguaauaggaguuggagaaaaaaaaauuacgcaucacuggcauagaagugguaguacaauuggaaaagcauuugaagcuacaguaaggggagcaaaaagaauggcaguacuaggagauacugcaugggauuucgguaguguuggaggugcacuaaauagccuuggaaaaggaauucaucagauauuuggagcagcauuuaaaucauuauuuggaggcaugaguugguucagucaaauauuaauuggaacucuauuaaugugguuagguuuaaacgcaaagaauggaucaauaaguuuaauguguuuagcacuaggaggaguauuaauauuccuuucaacagccguuucggcu

SEQ ID NO: 9959 - RNA, 1797 nt, Artificial Sequence
  ZIKV (strain MR 766) ME variant CDS opt
augggaaaaagaucagcaggaaguauaaugugguuagcaucacuagcaguaguaauagcaugugcuggagcagcaguaacauuaccaucacauucaacaagaaaauuacagacaagaagccaaaccugguuagaaucaagagaauacacaaaacauuuaauaaaagucgaaaacuggauauuuagaaauccaggauucgcucuaguagcaguagcaauagcuugguuacuaggaucaagcacaucacaaaaagugaucuaucuaguuaugauacuauuaauagccccugcauauucuauaaggugcauaggaguaagcaacagagauuuugucgaaggaaugucaggaggaacauggguagauguugucuuagaacauggagguugcguuacaguaauggcacaagauaaaccaaccguggauauugagcuaguaacgacaacaguaaguaacauggcagaaguaagaaguuauuguuacgaagcaaguauaucagacauggcaucagauucaagauguccgacucaaggagaagcauaucuagauaagcaaucagauacacaauacguuugcaaaagaacauuaguagauagaggauggggaaauggaugcggauuauuuggaaaaggaaguuuaguaacaugcgcaaaauuuacuuguaguaagaaaaugacaggaaaaaguauucaaccugaaaaucucgaauauagaaucaugcuaaguguucauggaagccaacauucuggcaugauaggauaugaaacagaugaagauagggcaaaaguagaaguuacaccuaauucaccaagagcagaagcaacauuaggagguuuuggaaguuugggacuagacugugaaccucgaacugguuuagacuuuagugauuuauacuauuuaacgaugaauaauaaacauuggcuuguacauaaagaaugguuucaugacauaccauuaccauggcacgcaggagcagauacaggaacaccacacuggaauaauaaagaagcauuaguagaguuuaaagaugcucaugcaaaacgacaaacagugguaguauuaggaucucaagaaggagcuguacauacagcucuggcgggugcauuggaagcagaaauggauggagcaaaaggacgacuguucagcggacauuuaaaaugcaggcuuaaaauggauaaauuaagauuaaaaggaguaucauauucacuauguacagcugcuuuuacauucacaaaagucccagcagagacucuacauggaacaguaacuguugaaguacaauaugccggaacagauggaccauguaaaauuccuguacaaauggcaguagauaugcaaacacuuacuccaguaggaagauuaauaacggcaaaccccguuauaaccgaaucaacagaaaauaguaaaaugaugcuagaacuagauccuccauuuggugauucauauauaguaauaggaguaggagacaagaaaauaacacaccauuggcauagaaguggaaguacuauaggaaaagcauuugaagcaacagugagaggagccaaaagaauggcuguacuaggagauacagcaugggauuucgguucaguaggcggaguuuuuaacucauuaggaaaagggauacaucaaauauuuggagcagccuucaaaucacuguucggcggaaugagcugguuuucucaaauauugauugggacccuauugguauggcucggacuaaauacuaaaaaugguagcauaucauuaacaugccuagccuuaggaggaguaaugauuuuccuuagcacagcaguuagcgca

SEQ ID NO: 9960 - RNA, 1809 nt, Artificial Sequence
  ZIKV (strain NatalRGN) ME variant CDS opt
augggcaaaagaucagcaggaagcaucaugugguuagcuaguuuagcagucguaauagccugugcaggagcagcaguaacauuaccgagccacucaacaaggaaauugcaaacccggagccaaacauggcuagaaaguagagaauauacaaaacaucuaaucagagucgaaaacuggauauucagaaauccuggauuugcauuagcagcagcagcaauagcauggcuauuaggaucaaguacaagucaaaaaguaauauaucuaguuaugauauuacuaauagcaccagccuacucaauaagauguauaggaguaagcaauagagacuuugucgaaggaaugagcggaggaacuuggguagauguaguauuagaacacggagguugcguaacggucauggcacaagacaaaccaacaguagacauugaauuaguaacaacgacaguuucaaauauggcagaaguccgaaguuacuguuaugaagcgucaauaucugacauggcaagugacucuagauguccuacucaaggagaggcuuauuuagauaaacaaagugauacacaauauguauguaaacgaacguuaguggauagaggaugggguaaugguugcggucuguucgguaaaggaucucuaguaacaugugcaaaauuugcuuguuccaagaaaaugacaggaaaaucaauacaaccagaaaauuuagaauaucgaauaauguuaaguguacauggaagucaacauaguggaaugauuguaaaugauacaggacaugaaacagaugaaaauagagcaaaaguggaaauaacuccaaauucaccaagagcagaagcuacauuaggaggcuuugguagcuuaggauuagacugcgaaccaaggacgggucuagacuuuagugaccuuuauuaucuaacaaugaauaauaaacauugguuaguacauaaagaaugguuccaugauauuccauuaccauggcacgcaggagcagauacuggaacaccacauuggaacaauaaagaagcauugguugaauuuaaagaugcacaugccaaaagacaaacaguaguaguacuuggaucccaagaaggagcaguacauacagcauuagccggugcauuagaagcagaaauggacggagcaaaagguagacuuagcagcggacaucuuaaauguagacuaaaaauggauaaauuaagauuaaaaggaguaucuuauagucuaugcacagcagcauucacuuuuacuaaaauacccgcagaaacguuacauggaacaguaacaguagaaguacaauaugcaggaacagauggcccauguaaaguaccagcacaaauggcaguugauaugcagacauuaacaccuguaggaagacuaauaacagcaaauccaguaauaacagaaucaacagaaaauaguaaaaugauguuggaauuagauccaccauucggagauucuuacauaguaauaggaguaggagaaaagaaaauaacccaucauuggcauagaucaggaaguacaauuggaaaagcauuugaagcaacaguaagaggagcaaaacgaauggcaguacuuggagacacagcaugggauuuugguucgguaggaggagcauuaaauucacuagguaaaggaauacaucaaauauuuggagcagcguuuaaaucacucuucgguggaaugucaugguucagucaaauucuaauaggaacauuauuaauguggcucggucuaaauacgaaaaauggaucaauuucacucauguguuuagccuuagguggaguccucauauucuuaucaacagcagucagcgca

SEQ ID NO: 9961 - RNA, 2085 nt, Artificial Sequence
  ZIKV (strain ZikaSPH2015) prME-short variant CDS opt
auggccauaagcggcguacccguccucggauucuucauaaucgcaguccucaugagcgcccaagaaaguugggccgucacccgcagaggaagugcauacuacauguaccucgaccgcaacgacgcgggagaagccaucuccuucccaaccacccuaggcaugaacaaaugcuacauccaaaucauggaccuaggacauaugugcgacgccacaaugagcuacgaaugccccaugcucgacgaagguguagaacccgacgacguagacugcuggugcaacacaacaucaaccuggguaguauacggaacaugccaucacaaaaagggagaagccagacgcagccgcagagccguaacacuacccucacacucgacacgaaaacuucaaacacggucacagaccuggcuagaaucccgugaauacaccaaacaccuuauaagaguagagaacuggaucuuccgaaaccccggguucgcccucgccgccgccgccaucgcauggcuacucggcuccagcacaucacaaaaaguuauauaccuaguuaugauccuccugauagccccugccuauagcauaagauguauaggcguaucaaaccgcgacuucguagaaggcaugucaggcggaacauggguggacauaguccuagaacacggcggcugcgucaccguaauggcccaagacaaaccaaccguagacauagaacuuguaaccaccacggugucaaacauggccgaaguacggagcuacugcuacgaagccucaauuuccgacauggcgagcgacuccaggugcccgacacagggagaagcauaccucgacaagcaaucagacacccaguacgucugcaagagaacacucguagacagaggcuggggaaacgguugcggacuguucggcaaaggcagccuggucacaugcgcgaaauucgccuguagcaaaaagaugaccggaaagucgauccaacccgaaaaccuagaauacaggaucaugcugagcguccauggcagccaacacagcggcaugaucguaaacgacaccggacacgaaaccgacgaaaaccgggcuaaaguagaaaucaccccaaacucccccagagccgaagccacgcuagggggauucggcucacuugggcucgacugcgaacccagaaccggacuagauuucagcgaucuauacuacuuaaccaugaacaacaaacacuggcucguacacaaagagugguuccacgacauaccccugccauggcacgccggcgccgacaccggcacaccacacuggaacaacaaagaagcgcuuguagaguucaaggacgcacacgcuaaacgccaaaccguaguagugcuggggagccaagaaggcgcgguacacacggcccucgccggggcacuagaagcagaaauggacggagccaaggggcggcugucaagcggccaccugaaaugccgccucaaaauggacaaacuuaggcuuaaaggagucuccuauagccuaugcacggccgccuucaccuucacaaaaauaccagccgaaacccuccacggcacuguaacagucgagguccaauacgccggcacagacggacccuguaaaguaccagcgcagauggccguagacaugcaaacgcuuacacccguaggacgccuaaucacagcaaacccaguaaucaccgaguccacagaaaacagcaaaaugaugcuugaacucgaucccccauucggggacuccuacauagucaucggcgucggcgaaaagaaaauaacccaccacuggcaccgcuccggcucaacgauaggaaaggcauucgaagcaacaguaagaggagcaaaaagaauggcaguccucggggacacagccugggacuucggaucgguaggcggcgcccucaacagccucggaaagggcauacaccaaaucuucggagcagccuucaaaucacuauucggaggcaugagcugguucagucaaauccugaucggcacccuccucauguggcucggccucaacacgaaaaacggauccaucucccucaugugccuagcacucggcggaguccucauauuccuuuccaccgcggugagcgcg

SEQ ID NO: 9962 - RNA, 2085 nt, Artificial Sequence
  ZIKV (isolate Z1106033) prME-short variant CDS opt
auggcaauaucgggaguacccguacugggauucuucauaauagcaguccucauguccgcacaagaauccugggcagucacaagacgcggauccgccuacuacauguaccuagaccgaaacgacgccggcgaagccaucucauucccaacaacacuaggaaugaacaaaugcuacauccaaaucauggaccucggacauacgugcgacgcaacaaugagcuacgaaugccccaugcuggacgaaggaguagaaccagacgacgucgacugcuggugcaacacaaccagcacuuggguaguauacggcacaugccaccacaagaaaggcgaagccagacgaagcagaagggcaguaacccuaccuucgcacucgacccgaaaacugcagacaagaagccagacauggcuggaaucacgcgaauacacaaaacaccucauacgagucgagaacuggaucuucaggaaccccggauuugcccuggcggccgccgcaaucgcauggcuccucggcagcucaacgucacaaaaaguaauauaccuggucaugauccuacucaucgcacccgccuacagcaucagaugcauaggagucagcaaccgggacuucguagaaggcaugagcggcggcaccuggguagaugugguucuagaacacggcgguugcgucacagugauggcacaagacaaacccaccguagauauagagcuagucaccaccaccgucagcaauauggccgaaguccggagcuacugcuacgaagccagcaucagcgacauggcauccgacagccgcugcccaacccaaggagaggcauaccuagacaaacaaagugacacacaauacgucugcaaacgaacacucguagacagaggcuggggcaacggauguggccucuucgguaaaggcucacucgucacaugcgcaaaauucgcaugcagcaagaaaaugaccggcaaaagcauccaaccagaaaaccuugaguauagaaucaugcuaucgguacacggaucccaacauucaggcaugaucguaaacgacacgggccaugaaacagacgaaaaucgagccaaaguagaaauaaccccgaacagcccgagggcagaggcaacacucgguggauuuggcagccugggccucgacugcgaaccccgaaccggucuugacuucuccgaccuguacuaccuaacaaugaacaacaaacacuggcucgugcauaaagagugguuccacgacaucccacugcccuggcacgccggcgcagacaccgguacgccacacuggaacaacaaagaagcacucgucgaguucaaagacgcacacgcaaaacgccaaacgguaguaguccucggcucacaagaaggagccgugcacaccgcccuagccggcgcacucgaagcagaaauggacggcgcaaaaggccgacucuccucaggccaccucaaaugccgccuaaaaauggacaaacugcgccucaaaggagucagcuacuccuuaugcacagcagccuucaccuucacaaaaauaccugcagaaacccuucacggcaccgucaccgucgaaguacaauacgcagguaccgacggccccugcaaaguaccagcccaaauggccguagacaugcaaacccugacccccgugggcagacuuauaaccgccaaccccguaauaacagaaagcaccgaaaacucaaaaaugaugcucgaacucgaucccccguucggcgacagcuauauagucaucggagucggcgaaaagaaaaucacacaucacuggcacagaucaggaagcaccaucggaaaagccuucgaggcgacaguacgcggagccaaacggauggccguccucggagacaccgccugggacuucggaucaguaggaggggcacuuaacucccuaggaaaaggcauccaccaaaucuucggcgcagccuucaaaucacuauucggggguauguccugguucucccaaauccuaaucggaacucuccucauguggcucggacucaacgcgaaaaacggcaguaucagccucaugugccucgcacuaggaggagugcuaauauuccuaucaacagcagucagcgcc

SEQ ID NO: 9963 - RNA, 2073 nt, Artificial Sequence
  ZIKV (strain MR 766) prME-short variant CDS opt
auggccaucucaggcgucccagugcucggauuuuucaucauagcaguauuaaugagcgcgcaagaaaguugggcaauaaccagacgcggcuccgccuacuacauguaccuggaccgcuccgacgcaggcaaagccaucagcuucgcaaccacccucggaguaaauaagugccacgugcaaauaauggaccuaggccacaugugcgacgccacaaugucauacgaaugcccgaugcucgacgaaggaguagaacccgacgacguggacugcuggugcaacacaacguccacauggguaguauacggaaccugccaccacaagaaaggagaggcaaggcgaagccgcagagcaguaacccuacccagccacaguacacgaaaacuacaaacgcggagccaaacuuggcuggaaucacgcgaauacacaaaacaccuaauaaaaguggaaaacuggauauuccggaaccccggauucgcacugguggcaguagcgauagccuggcugcucggcagcucaaccucccaaaaagucaucuaccucguaaugauacuccugauagcaccagcguacuccauaaggugcauaggcgucagcaaccgugauuucgucgagggaaugucaggaggaaccuggguagacguaguccuagaacacgggggcugcgugaccgucauggcccaggacaagccuacagucgacauagaacucgucacaaccacgguaagcaauauggcagaaguaagaagcuacuguuacgaagcaucaaucagcgacauggccagcgacucaagaugcccaacccaaggagaagccuaccuagacaaacagagcgacacccaauacgucugcaagcggacgcucguagacagaggcuggggaaauggaugcggccucuucggaaagggaagccuagugaccugcgccaaauucacaugcagcaagaaaaugacaggaaaauccauccaacccgagaaccucgaauaccgcauaauguuaagcguccacgggucacaacauagcgguaugaucggcuacgaaaccgacgaagacagggcaaaaguagaaguaacccccaacagcccaagagcugaagccacacucggaggauucggcagccuaggacuagacugcgaaccacgcacuggacuugacuucuccgaccuauacuaccucacgaugaacaacaagcacuggcuaguccacaaagaaugguuccacgacauaccccuaccuuggcacgccggcgcggacaccggaacaccacacuggaacaacaaagaggcacucgucgaguucaaggaugcacaugccaaacgccaaacagucguaguacugggaagccaggaaggagccguacacacagcccucgcaggagcacucgaagcugaaauggacggcgcaaaaggccggcuuuucagcggccaccucaaaugccggcuaaaaauggacaaacuccggcugaaagggguaagcuacagccucugcaccgcagcguuuacguucaccaaaguacccgcagaaacacuacacggcacaguaacagucgaggugcaauacgcaggcaccgacggccccugcaagauaccaguacaaauggcagucgacaugcaaacacugacaccugucgggcgacuaauaaccgcaaacccagucaucaccgaaagcaccgagaacagcaaaaugaugcucgagcuagacccaccauucggcgacagcuacaucgucauaggcgugggcgacaagaaaaucacacaccacuggcacagguccggcagcaccaucggcaaagccuucgaagcgacaguacgcggagcaaaacgaauggcagucuugggcgacacagccugggacuucggcagcgucggcggagucuucaacucacuagggaaaggaauacaccagauauucggagccgccuucaagagccuauucggaggaaugagcugguuuagccagauacucauaggcacccuacucgucuggcuaggucuaaacacaaagaacggcuccaucucauuaacaugccuggcauugggcggagugaugauauuucucagcacagccguaagcgcg

SEQ ID NO: 9964 - RNA, 2085 nt, Artificial Sequence
  ZIKV (strain NatalRGN) prME-short variant CDS opt
auggccauauccggcguaccaguccucggguucuucauuauagcaguccucaugagcgcacaagaaucgugggccguaaccagacgaggaucugcauauuacauguaccuagaccggaacgacgcgggagaagccaucucauuucccacaacacucggaaugaauaaaugcuacauccaaaucauggaccucggccacaugugcgacgcaacgaugagcuacgaaugccccaugcuagacgagggggucgaacccgacgacgucgacugcuggugcaacacaacaucaaccuggguaguauacggcacaugccaccacaaaaagggcgaagcccgacgauccaggcgagcaguaacauuacccucccauuccacccgcaaacuccaaacgcgcucgcaaaccuggcuagaaucacgagaauacacaaaacaccucauccgaguagaaaacuggaucuucagaaauccgggauucgcccuggccgcugccgccaucgccuggcuacucggcuccagcaccucacagaaagucaucuaccucguuaugauacuccucauagcgccagccuacucuauccgcugcaucggaguaagcaaccgagauuucguagaaggcaugucaggcggcacaugggucgacgucguccuagaacacggaggcugcguaacagucauggcccaagacaaaccgaccgucgacaucgagcuaguaaccacaaccgucuccaauauggccgaaguccgaagcuacugcuacgaagcgucaaucuccgacauggcaagcgacucccgaugcccaacccaaggcgaagccuaccuagacaaacaguccgacacccaauacguuugcaaacgcacacucgucgaccgaggauggggcaacggcugcggccucuucgggaaaggaagccucguaaccugcgcaaaauucgcaugcagcaagaaaaugaccggaaaauccauccaacccgaaaaccuggaauaccgcauaaugcucucaguacacggaucccagcacagcggaaugauagugaacgauacaggacacgaaacugacgaaaaccgagcaaaaguagaaaucacccccaacucaccacgagcagaagccacccuaggcggauucggcucauuaggccucgacugcgaaccuaggacgggccucgacuucuccgaccuauacuaccugacaaugaacaacaaacacuggcuaguacacaaagaaugguuucacgauaucccccuacccuggcacgccggcgccgacacaggcacaccgcacuggaacaacaaggaagccuuaguagaguucaaagacgcccacgccaagcgccaaaccgucgugguccugggaucccaagaaggcgccguacacaccgcccuagcaggcgcccuugaggccgaaauggacggggcaaaaggccgccuaucauccggacaucucaagugccggcucaaaauggacaaacuacgacuaaaaggcguaagcuacucccucugcacagccgcuuucacauucaccaaaauaccagcggaaacucuccacggcaccgucaccgucgaagugcaauacgccggaacagacggaccaugcaaagugcccgcccaaauggccgucgacaugcagacucuaaccccaguagggcgacucauaaccgcaaaucccgucaucaccgaaagcaccgagaacagcaaaaugaugcucgaacuggacccucccuucggcgacagcuacaucgucaucggaguaggcgaaaagaaaaucacccaccacuggcaccgaucgggaagcaccaucggcaaagccuucgaagcgacagucagaggcgcaaaacgcauggccguccucggagacaccgcaugggacuucggcagcgucggaggcgcacucaacucucugggcaaagggauccaccaaauauucggcgccgccuucaaaucccucuucgggggaaugucgugguucucacagauacuuauaggaacacuacucauguggcucggacuaaacaccaaaaacggcuccauaucccucaugugccuagcccuaggaggaguccuaaucuuccucucgacagcggucuccgcc

SEQ ID NO: 9965 - RNA, 2064 nt, Artificial Sequence
  ZIKV (strain ZikaSPH2015) prME-short variant CDS opt
auggacuggacauggauacucuuccuaguagccgccgccacccgcguacacucagugacgcgccgcggcucagcauacuacauguaccucgaccggaacgacgccggagaggcgauaucauuccccaccacacuaggaaugaacaaaugcuacauacagaucauggaccucggccacaugugcgacgccacaauguccuacgagugcccaaugcuggacgaagggguagaaccagacgacgucgacugcuggugcaacaccacguccacauggguggucuacggcacaugccaccacaagaaaggagaagcgcgccgaucacgcagagccgucacccucccaagccacuccacaagaaaacuccaaaccagaagccaaacuuggcucgaaucccgggaauacaccaagcaccucauacgcguagagaacuggauauuccgcaacccaggcuucgcgcuagcagccgccgccauagccuggcuacuaggcucauccacaucacaaaaagugaucuaucuaguaaugauacuacuaauagcacccgccuacagcaucagaugcauaggcgucucaaacagagacuucguagaaggcaugucaggaggaaccuggguagauaucguacucgaacacggcggauguguaaccgucauggcccaagacaaacccacuguagauaucgagcuaguaacaacaacaguauccaacauggccgaaguaagauccuacugcuacgaagcaucaaucucagacauggccucagacucgaggugcccuacucagggagaagccuaccuagacaaacaaagcgacacgcaauacgucugcaaaagaacccuagucgauagaggcuggggaaacgggugcgggcuauucggcaagggaucacucguaaccugcgcaaaguucgcaugcuccaagaaaaugaccgguaaaagcauccaacccgaaaaccucgaauacagaaucaugcuaucgguacacggaucccagcacuccggaaugauuguuaacgacacgggucacgaaacagacgaaaaccgggccaaggucgaaauaacaccaaacagcccacgagcagaagccacccuaggaggcuucggcucccucggccucgacugcgaaccccguaccggcuuggacuucagcgaccuauacuaccucaccaugaacaacaaacacuggcugguccacaaagaaugguuccacgacauuccccuccccuggcacgcaggggccgacacaggaaccccacacuggaacaacaaagaggcccuuguagaguucaaagacgcacacgcaaaacgccaaacagucgucguccucggcucgcaagaaggagccguacacacagcacuagccggcgcacuagaagcagaaauggacggcgcaaaaggccgccuaagcucaggccaccucaagugccggcucaagauggacaaacuacgccuaaaaggagucucauacucccuaugcaccgcggccuucaccuucaccaaaaucccggcagagacccuacacggaaccguaaccguugaaguucaauaugccggaaccgacggacccugcaaaguacccgcccagauggcagucgacaugcaaacacuuaccccaguuggccgccucaucacggcaaaucccgucaucaccgaaaguacagaaaacucaaaaaugaugcuagaacuagacccgcccuuuggcgacucauacauagucauagggguaggagagaaaaagauaacccaccacuggcaccgcagcggguccacgauagguaaagccuucgaagcaaccguaagaggcgcgaaacgaauggcaguacuaggugacaccgcaugggacuucgggagcgucggcggggcacuaaauucacuugggaagggaauccaccaaaucuucggggccgcauucaagagucucuucggcggcaugagcugguucucacaaauccucauaggaacccuccuaauguggcuaggccucaacaccaaaaacggaagcauaucccuaaugugccuagcacucggaggcguacucaucuuccucagcacagcgguaagcgcg

SEQ ID NO: 9966 - RNA, 2064 nt, Artificial Sequence
  ZIKV (isolate Z1106033) prME-short variant CDS opt
auggacuggacguggauacuauuccucguagccgccgcaacccgcguccacagcguaacccgaagaggcuccgcuuacuacauguaccucgaccgaaacgacgccggcgaagccauaucauuccccaccacccucggcaugaacaaaugcuacauccaaauuauggaccuagggcacacuugcgacgccacaaugagcuacgagugccccaugcucgacgaaggcgucgaaccagacgacguggacugcuggugcaacaccaccagcacauggguaguauacggaaccugccaccacaagaaaggcgaagcccgaagaucacgccgggccguuacccuccccucacacuccacacgaaagcuccaaacccgcucccaaaccuggcucgaaucucgagaauacacaaagcaccuuauaagaguugagaacuggaucuucagaaaccccggcuucgcccuagccgcagccgcaaucgccuggcuccucggcuccucaacaucccaaaaagucauauaccuugucaugauccuccucauagcaccagccuacucgauccgaugcaucggcguuuccaaccgcgacuuugucgaaggcaugaguggaggcaccugggucgacguaguacuagaacacggaggcugcgucacaguaauggcacaagacaaaccgacaguagacaucgagcuaguuacaacaaccguaucuaauauggccgaaguccgcucauacugcuacgaagccuccaucuccgacauggcauccgacuccagaugcccuacccaaggcgaagccuaccucgacaaacaauccgacacccaauacgucugcaaacgcacccucguagaccgaggguggggcaacgguugcggccuguucggaaagggaucccuagucacaugcgcaaaguuugccugcuccaagaaaaugacgggaaaaucaauacaacccgaaaaccuagaauaccgcauaaugcucagcguccacgggucacaacacagcgguaugauagugaacgacacuggacacgaaacagacgagaacagagcgaaagucgaaaucacaccgaacuccccucgcgcagaagccacgcuaggaggguucggaucacuuggacucgacugcgaaccccgcaccggccucgacuucagcgacuuauacuaccuaacaaugaacaacaaacauuggcuaguccacaaagaaugguuccacgacauaccccuacccuggcacgccggcgcagacacaggaacaccccacuggaacaauaaagaagcccucgucgaguucaaagacgcccacgcgaaaagacaaaccgucguuguacugggcagccaagaaggcgccguccacaccgcacuagcgggggcucuagaagcagaaauggauggcgccaaggggcgacuaucaucaggccaccucaaaugcagacuaaaaauggacaaacuccgccucaaaggaguaucauacucacuaugcaccgccgcguucacauucaccaaaauacccgcugaaacucuccacggaacagucaccgucgaaguccaauacgcaggaaccgacggccccugcaagguaccagcccaaauggccguagacaugcaaacacuaacccccgucggaagacuaaucaccgcgaaccccguaauaacagaauccacagagaacucaaaaaugaugcucgaacuagacccaccguucggagacucuuacauagucauaggagucggagagaaaaagaucacacaccacuggcaccgcucaggcucaacaauuggcaaagccuucgaagccacgguacggggagccaaaagaauggccguacuaggggacacagccugggacuucggaucagucggcggugcacuaaauucacuaggaaaaggcauccaccagaucuucggcgcagccuucaaaagccuauuugguggaaugucaugguucagccaaauccucauagggacccuccucauguggcucggccucaacgcuaaaaacggaagcaucucgcuaaugugccuagcccucgggggcguccuaauauuccucagcacggcagucagcgcc

SEQ ID NO: 9967 - RNA, 2052 nt, Artificial Sequence
  ZIKV (strain MR 766) prME-short variant CDS opt
auggacuggaccuggauacuguucuuaguagccgccgccacgcgaguccacagcauaacacgcaggggaucagcauacuacauguaccucgaccgauccgacgccggaaaagcaauaucauucgcaaccacgcuaggagucaacaaaugccacgugcaaaucauggaccuaggucacaugugcgacgccaccauguccuacgagugcccuaugcucgacgaaggaguagaaccagaugacgucgacugcugguguaacacaaccuccacaugggucgucuacggcacaugccaccacaagaaaggagaagccagacgaagccgucgcgccgucacacuaccaagccacagcacaagaaaacuccaaacccggucacaaacauggcuugaaagccgagaauauacaaaacaccucauaaaaguagaaaacuggaucuuccggaacccaggguucgcgcucguagccguggcaauagccuggcuccucggauccagcacaucccaaaaagucaucuaccuaguaaugauccucuugauagcacccgccuacucaauacgaugcauaggagucagcaaccgcgauuucguagaaggaauguccggcggaacaugggucgacgucguccucgaacacgguggaugcgucaccgucauggcacaagacaaacccacagucgacauagagcuagucaccacaacuguaagcaacauggccgaaguacgcuccuacugcuaugaagcauccauauccgacauggcaucggacagccgcugcccaacgcaaggcgaagccuaccuagacaaacaaucagauacccaguacgucugcaaaaggacccuaguagaccgaggauggggcaacggaugcggacucuucggaaaaggcagccuaguaaccugcgcaaaauucacaugcuccaagaaaaugacaggaaaaagcauacaaccggaaaaccuagaguacaggaucaugcuaagcgugcacggcucccaacacucaggaaugauaggcuacgaaaccgacgaagaccgagcaaaagucgaaguaacacccaacucaccccgggcagaagcaacccuagggggauucggaucccuaggacucgacugcgaaccccgcacaggacuggacuucuccgaccuauacuaccuaacgaugaacaacaaacacugguuaguccacaaagagugguuccacgauaucccccuaccauggcacgccggagccgacacaggaacgccacacuggaacaacaaagaagcccuagucgaguucaaagacgcacacgccaaaaggcagacagucguagugcuaggcucgcaagaaggggcaguccacaccgcacucgccggagcacuagaagccgaaauggacggagccaaggggcggcuauucucaggccaccugaaauguagacuuaagauggauaaacugcgacuaaaaggagugagcuacucccucugcacagccgcauucacguucacaaaaguaccggccgaaacacugcacgggacagucaccguugaaguccaauacgcagggacugacggccccugcaaaauccccguccaaauggccgucgacaugcaaacccuaacccccguaggacgacuaaucacggcaaacccuguaauaacagaaucaacagaaaacagcaaaaugaugcuugaacuagacccaccauucggagacuccuacaucguaaucggaguaggugacaagaagauaacacaccacuggcacagaagcggcuccacaaucgggaaagcguucgaagccacaguccgcggcgccaaaagaauggcuguacuaggagacaccgcaugggacuucggcuccguaggcggagucuucaacucgcuagggaaaggaauacaccaaauauucggagcagccuucaaaucccuauucggaggaauguccugguucucgcaaauccuaaucggcacacuccuggucuggcuaggacuaaacacgaaaaauggaagcauuucccuaacaugccucgcccucggaggaguaaugauauuccucagcaccgccguaagcgcc

SEQ ID NO: 9968 - RNA, 2064 nt, Artificial Sequence
  ZIKV (strain NatalRGN) prME-short variant CDS opt
auggacuggaccuggauacuauuccucguagccgccgcaacacgaguccacagcguaaccaggcgcggaucagccuacuacauguaccuggaccgaaacgaugccggcgaggcgauaucauuccccacaacccucggcaugaacaaaugcuacauccagaucauggaccucgggcauaugugcgacgccaccauguccuaugaaugcccgaugcucgaugaaggagucgaaccagacgacgucgacugcuggugcaacaccaccagcaccugggucguauacggaaccugccaccacaagaaaggcgaagcccgccgaagcagacgcgcagucacacuaccaagccacucaacacgaaaacuacaaacccgaucacaaaccuggcucgaaucccgagaauacacaaaacaccuaauccgagucgaaaacuggauauuccgaaacccaggauucgcccucgcggccgccgccauagccuggcuacugggauccagcacaagccaaaaagucaucuaccuugucaugauccuacuaaucgccccagccuacuccauacgaugcaucggagucagcaacagagacuucgucgaaggcaugucaggaggaacauggguagacguaguacucgaacacggcggcugcguaaccguaauggcccaagacaaacccacaguagacauagaacuuguaaccaccacagucuccaacauggcagaaguccgcucauacugcuacgaagcauccaucagcgacauggcaagcgacucacgcugcccaacccaaggcgaagcauaccuggacaaacaaagcgacacgcaauacgucugcaaaagaacacucguggaccgcggauggggcaauggaugcggccucuucggcaaggggagccuagugaccugcgcaaaauucgccuguucaaagaaaaugaccggcaaaagcauacaaccugagaaccucgaauaccgcauuaugcugagcguccacgggagccaacacagcggcaugaucguaaacgacaccggucacgaaaccgacgaaaaccgcgccaaagucgagaucaccccaaacucaccccgcgccgaggcuacacugggaggauucggcucacuagggcuugacugcgaaccgagaacaggcuuagacuuuucagaccuuuacuacuuaaccaugaacaacaaacacuggcucguccacaaagaaugguuucacgacaucccccugccauggcacgccggcgcugacaccgguacaccacacuggaacaacaaagaggcccuaguagaguucaaagacgcccacgcaaaacgccaaaccguagucguacuaggcucccaagaaggagcaguacacaccgcccuggccggagcacuagaagcagagauggacggagccaaggggcgccucagcuccgggcaccucaaaugucgccugaaaauggacaagcuaaggcuaaagggcguauccuacucccuaugcacagccgccuucaccuucaccaaaaucccagcagaaacccuccacggaacggugacuguggaaguccaauacgcaggaaccgauggacccugcaaaguacccgcacagauggcgguggacaugcaaacccuaacgcccgucggacgccucauaaccgccaacccagucauaacagaaucaacagaaaacagcaaaaugaugcucgagcucgacccacccuucggagacagcuacaucgucaucgggguaggcgaaaagaaaauaacccaccacuggcacagaucaggaucuacaaucggaaaagccuucgaagccaccguccgcggugcgaaacgaauggccguccuaggcgacaccgccugggacuucggcagcgucgggggcgcacucaacucccuaggaaaaggcauccaccaaaucuucggcgccgccuucaaaagccucuucggaggcaugucaugguucagccagauccucauaggcacacuccuaauguggcuaggccucaacaccaaaaacgggucaauuagccuaaugugccucgcacugggaggcgugcuaaucuuccuaagcaccgcagucucggca

SEQ ID NO: 9969 - RNA, 2082 nt, Artificial Sequence
  ZIKV (strain ZikaSPH2015) prME-short variant CDS opt
augggaaaaagaagcgcaggaucaauaauguggcuagcuucccuggccguaguaaucgccugcgcaggcgcaguaacacgucgaggguccgcauacuacauguaccucgauaggaacgacgcaggagaggcaaucucuuuccccaccacacuaggcaugaacaaaugcuacauccaaaucauggaccuaggacacaugugcgacgccacuauguccuacgaaugccccaugcuagacgaaggaguagaaccggacgacguugacugcuggugcaacaccacaucaaccugggucgucuacggaacaugccaccacaagaaaggagaagccagacgaagcagacgagccguuacacuaccaucccacagcacaagaaaacuacaaaccagaucacagaccuggcuagaaagcagagaauacaccaaacaucuaauccgagucgaaaacuggaucuucagaaaccccggcuucgcccuggcagcagccgcaauagccuggcuccucggcagcaguacaucccaaaaagugauauaucucgucaugauacuauugaucgcacccgcauacagcaucagauguauaggcgucagcaaccgugacuucguagagggaaugagcggcgggaccugggucgacaucguccuggaacacggcggaugcguaaccguuauggcacaggacaaacccaccguagacaucgagcuaguaacaaccacagucuccaacauggccgaaguacgcuccuacugcuacgaagcguccauaagcgacauggcaagcgacagccgcugcccaacccaaggggaggcauaccuagacaaacaaagcgacacucaguacgucuguaaaagaacacucguagacagaggauggggcaauggaugcggccuauucggaaaaggcagccucguaaccugcgccaaauucgcaugcaguaagaaaaugaccggaaaaagcauacaacccgagaaucuagaguaccggaucaugcucagcguacacggcucccaacacuccggaaugauaguaaacgacacaggacacgaaacagacgaaaaccgggccaaagucgagaucacaccaaacuccccaagggccgaagccacccugggcgguuucggcagccuaggacuagacugcgaaccccgcaccggccucgacuucagcgaccuauacuaccuaaccaugaacaacaaacacugguuaguccacaaagaaugguuccacgacauaccccucccguggcacgcaggcgcagacaccggcaccccucacuggaacaacaaagaagcacucgucgaguucaaagacgcccacgccaaaaggcaaaccgucgucguacucgggucacaagaaggagccguacacaccgcacuagccggagcccuagaagcagaaauggacggcgcaaaagggagacuauccuccggccaccucaaaugccgacugaaaauggauaaacuacgacuaaaaggcgucagcuacagccugugcaccgcagcauucaccuucaccaagauacccgccgaaacccuccacggaacagucaccgucgaaguccaauaugcaggaacagacggccccugcaaaguccccgcacaaauggccguggacaugcaaacccuuacaccaguaggaagacucaucacagcaaacccggucaucaccgaaagcacggaaaacucgaagaugaugcucgagcuagacccgcccuucggagauagcuauauaguaauaggaguuggagaaaagaaaauaacccaccacuggcacagaagcggguccacaaucggaaaagcauucgaagcgacaguacgaggggccaaacgaauggcaguccucggagacacagccugggacuucggauccguaggaggagcccuaaacucgcucggcaaaggcauacaccaaaucuucggcgccgcguucaaaucccuauucggaggcaugagcugguucagccaaauacuaauagguacccuacucauguggcucggacugaacaccaaaaacggaagcaucagucuuaugugccuagcacucggaggcguacuaauauuccuaucaacagccguaagcgcc

SEQ ID NO: 9970 - RNA, 2082 nt, Artificial Sequence
  ZIKV (isolate Z1106033) prME-short variant CDS opt
augggcaaaagguccgccggaagcauaauguggcuggccagccuagcagucgugaucgcaugcgccggcgcgguaacacgccggggcucggcauacuacauguaccucgaccgaaacgacgccggggaagccaucagcuucccgaccacucucgggaugaacaagugcuacauacagauaauggaccuuggacauaccugcgacgcaacaaugagcuacgaaugcccaauguuagacgagggaguagaaccagacgacguggacugcuggugcaacacaacguccaccuggguagucuacggaaccugccaccacaagaaaggcgaggcgcgaagaagccgccgagccgucacacuacccagucacucaacacggaaacuacaaacaagaucacaaacauggcuagagagcagggaauacaccaaacaccucauccgagucgagaacuggauauucagaaacccaggcuucgcccucgccgccgcggcgauagccuggcuacucgggagcuccacaagccagaaaguaauauaccuagugaugauacuccuaauagcgccugcauacucgauccgaugcauuggaguaagcaaccgcgacuucguggaaggcaugucaggcggaaccuggguagacguaguccuagagcacggaggcugcguaaccguaauggcccaggacaaacccacagucgacaucgagcuagucacgacaaccgucagcaacauggcagaaguacguagcuacugcuacgaagcaucaaucucagacauggcaucagacagucgaugccccacacaaggagaagccuaccuagacaaacagucagacacacaauacgucugcaaaaggacccucgucgaccgaggcugggggaacgggugcggauuguucggcaaaggaucccucguuacaugcgcaaaauuugcauguucgaagaaaaugacugggaaaucaauacaaccggaaaaucuggaauacagaaucaugcuauccguacacggcagccagcacagcgguaugaucgucaaugacaccggccacgaaacugacgaaaacagagcaaaagucgaaaucacgcccaacagcccacgggcggaggccacacucggaggcuucggaucacuaggccuagacugcgaaccacgcaccggccuagacuucagugaccuauauuaccugaccaugaacaacaaacacuggcucguacacaaagaaugguuccacgacauaccccuaccguggcacgcgggggccgacaccgggacaccacacuggaacaauaaagaagcccuaguagaguucaaagacgcgcacgccaaacgccaaacagucguaguacucggcucacaagaaggagccguccacaccgcacucgcaggagcucucgaagcagaaauggacggagccaaaggacgacuuagcagcggacaccuaaaaugcagacucaaaauggacaaacucagauuaaaaggagucagcuacucgcuaugcacagcagcauucaccuucacaaagauccccgcggaaacccuacacgggacggucacaguagaaguccaauacgccggcacggacgggccaugcaagguucccgcacaaauggcggucgacaugcagacacugacaccagucggcagacuaauaaccgcgaaccccguaauaacagaaagcacagagaacucgaaaaugaugcuggaacuagacccaccguucggagacucauauauugugaucggaguaggagaaaagaaaauaacacaccacuggcaucgcagcgggagcacaaucggaaaagcauucgaagcuacaguccgcggcgccaaaagaauggcagugcucggcgacacggccugggacuucggaucaguaggcggagcccuaaacucacuuggaaaaggaauacaccaaauauucggcgcagcguucaaaagucucuucggcgggaugucaugguucagccaaauccucaucggcacccuacuaauguggcucggccuaaaugcaaagaacggcagcauaagccucaugugccuagcccuaggaggaguacuaaucuuccuaaguaccgccguaagcgca

SEQ ID NO: 9971 - RNA, 2070 nt, Artificial Sequence
  ZIKV (strain MR 766) prME-short variant CDS opt
augggcaagcgaucagccggauccaucauguggcucgccagccuagcaguagucaucgcaugcgcaggggccaucacaagacgaggcuccgcguauuacauguaccuagaccguagcgacgccggaaaggcaaucagcuucgcaaccacccugggagucaacaaaugucacguacaaaucauggaccuaggacauaugugcgacgcaaccaugagcuacgaaugccccaugcuagacgaaggcgucgaacccgacgacguagacugcuggugcaacacaacuucaacaugggucgucuacggaacaugccaccacaaaaagggcgaagcaagacgcucccguagagccgugacccugccaagccacucaaccagaaaacugcaaacaagaucacaaacauggcuagaaagccgcgaguacacgaaacaccucauaaaaguagaaaacuggaucuuccgcaaccccggguucgcacucguagccgucgcaauagccuggcugcucggcuccagcacaucccagaagguaauauaccuagucaugauccugcucaucgcgccagcauacuccauacgaugcaucggcgucagcaacagagauuucguagagggaaugagcggcggcaccuggguagaugucguccuagaacacggaggcugcgucaccguaauggcacaggacaagcccacaguagacauagagcuagucacgacaacagucagcaacauggcagaaguaagaagcuacugcuaugaagcaucuaucagcgacauggcgagcgacagccgaugccccacgcaaggcgaggccuaccucgacaagcaguccgacacucaauacguaugcaaacgaacccucguagaccgggguuggggaaacggaugcgggcuauucggaaaaggcucccuaguaaccugcgccaaauuuaccugcuccaagaaaaugaccggaaaaucgauccaaccagaaaaccuggaauauagaauaaugcucagcguccacggcagccaacauucuggcaugauaggcuacgaaaccgacgaggacagggcaaaagucgagguaacgccaaacagcccaagggcagaagcgacccucggaggauucggcagccucggacucgauugcgaaccccgcacaggccucgacuucucagaccucuacuaccucacaaugaacaacaaacacuggcucguacacaaggaaugguuccacgacauaccacugcccuggcaugccggcgcugauacaggaacaccacacuggaacaacaaagaagcccucguggaguucaaagacgcccacgcaaaacgccaaaccguaguaguccuaggaagccaagaaggcgcgguacacacagcccucgccggagcccuagaagcagaaauggacggagccaaagguagacuauucucuggacaccucaaaugccgauuaaaaauggacaaacuccgacuaaaggguguaucauauagccuaugcacagcagccuucacauucacaaaggugccagcagaaacgcuucacgggaccgucaccgucgaaguacaguacgccggcacagacggaccgugcaaaauaccaguccagauggcaguagacaugcaaacacucacaccggucggcaggcuaauaacagccaacccaguaauaacagaaagcacagagaacagcaagaugaugcuagaguuagacccgcccuucggggacagcuacauaguaauaggcgucggagacaagaaaauaacacaccacuggcaccgaucaggcagcacgaucggaaaagccuucgaagcaaccguaaggggcgccaaaagaauggcaguacuuggagacacagcaugggacuucggaagcgucggcggaguauucaauaguuuaggcaaaggcauacaccagauauucggagccgccuucaaaucacuauucggagggaugucaugguucagccaaauccucauaggcacccuacucguauggcuaggccucaacaccaaaaauggcuccauaagucugacaugccucgccuuaggcggcguaaugauauuccuaucaaccgccguaagcgcc

SEQ ID NO: 9972 - RNA, 2082 nt, Artificial Sequence
  ZIKV (strain NatalRGN) prME-short variant CDS opt
augggaaaacgcucagcgggaucaauaauguggcucgccucccuagcagucgucaucgccugcgccggagccgucacucgccgcggcuccgcauacuacauguaccucgaccgaaacgacgccggagaagccauaucauuccccacaacccucggaaugaacaaaugcuacauccaaaucauggaccuaggccauaugugcgacgcaacgaugucauacgaaugccccaugcucgacgaaggaguagaacccgacgacguagacugcuggugcaacacaacgagcaccugggucgucuacgguaccugccaccacaagaaaggcgaagcccgcagauccagacgagcaguaacucucccaucccacagcacccgcaaacuacagacaaggucgcaaaccuggcucgaaagcagagaauacacaaaacaccucauccgcguagagaacuggaucuuccgaaaucccgguuucgcccuagcagccgcagcaauagcauggcuccucggcucaagcaccagucaaaaaguaauauaccuagucaugauacuccuaauagcacccgcauacagcauaagaugcaucggcguaucgaaccgcgacuucgucgagggaauguccggaggaacguggguugacguaguacuagagcacggcgggugcguaacuguaauggcccaagacaaacccacaguugacauagagcucgucaccacaacggucucaaacauggccgaaguccggaguuacugcuaugaagcgagcaucagcgacauggcauccgacucccgaugccccacacaaggcgaagccuaccuagacaaacagucagacacacaauacgucugcaaacggacacucgucgacagaggauggggcaacggcugcggccucuucggcaaaggcagccuugucaccugugcgaaauuugccugcagcaagaaaaugaccggcaaauccauacaacccgaaaaccuggaauaccgaaucaugcugucaguccacggaucccaacacagcggaaugaucguuaacgacacaggucacgaaaccgacgaaaauagagccaaaguagaaauaacaccgaacagcccccgagccgaagccacacuaggagguuuuggcucccucggccucgacugcgagccacgcaccggacucgauuucucagaccucuacuacuuaacgaugaacaacaaacacuggcucguccacaaagaaugguuccacgacaucccccucccauggcacgcaggagcagacacaggcacaccacacuggaacaacaaggaagcccuagucgaguucaaagacgcccaugccaaacgccaaaccguagucgugcucgguucacaagaaggcgccguccacacggcacucgccggagcacucgaagccgaaauggacggcgcaaagggacgacuauccucaggccaccucaaaugcagacucaaaauggacaaacuaaggcuaaaaggcguaagcuacucccuauguacagcagcauucacauucaccaaaaucccagcagaaacacuucacggcacagucacaguagaaguccaauacgccgggacagacgggccaugcaaagugccggcacagauggccguagacaugcaaacccuaacccccguaggccgucucaucaccgccaacccaguaaucaccgaaagcaccgaaaacuccaaaaugaugcuagaacucgacccacccuucggggacaguuacaucguaaucggaguaggggaaaagaaaaucacccaccacuggcaccgauccggcuccaccaucgggaaggcuuucgaagcaacgguacgcggcgcaaaacggauggcgguacucggagacacagccugggacuucggcagcgucggcggagcccugaacucacuagggaaaggaauacaccaaaucuucggcgccgccuucaaaucgcuauucgggggcaugagcugguucucacaaaucuuaaucggaacccuacucaugugguugggccugaacaccaagaacggauccaucucacugaugugucuagcucucggcgggguacucaucuuccugagcaccgcagucagcgcc

SEQ ID NO: 9973 - RNA, 2085 nt, Artificial Sequence
  ZIKV (strain ZikaSPH2015) prME-short variant CDS opt
auggccaucucaggcguaccaguccuaggguucuucaucaucgccguccucaugagcgcccaagaauccugggccguaacccgccgaggauccgccuacuacauguaccuagacagaaacgacgcaggagaagccaucuccuucccgacaacacucggaaugaacaaaugcuacauacaaaucauggaccucggccacaugugcgacgcaacaaugagcuacgaaugucccaugcuagacgaaggagucgaacccgacgacgucgacugcuggugcaacacuaccagcaccuggguggucuacggaaccugccaccacaaaaagggcgaagcacgacgaaguagacgcgccgucacccuccccagccacucaacacguaaacuacaaacccgaagccagaccuggcucgaaagccgagaauacaccaaacaccucaucagaguagaaaauuggaucuucagaaaccccggguucgcacuggcggcagccgccaucgccuggcuacucggaucuagcacgucccaaaaggucauauaccuggucaugauccuacuuaucgccccagcauacuccauccgcuguauaggcguauccaaccgugacuuugucgaaggcauguccggcggaaccugggucgacauaguccucgaacacggcggaugugucaccguaauggcacaggacaaaccaacagucgacaucgagcuaguaaccaccaccgucuccaauauggcagaaguaagauccuacugcuacgaagccucaaucagcgacauggccucagacagccgaugccccacacaaggcgaagcauaccuagauaagcagucagacacccaguacgucugcaagcgcacccuagucgaccgcggauggggaaacggcugcgggcuauucggaaaaggaagccuaguaaccugcgccaaguucgcuuguucaaagaaaaugaccggaaaauccauacaaccagaaaaccucgaauaccgcaucaugcuauccguacacggcucacaacacagcggcaugauaguaaacgacaccggacacgaaaccgacgaaaaccgggccaaagucgaaauaacaccgaauagcccccgcgccgaagcaacccucggcggauucggaucccucggguuagacugcgagccccgcacuggccucgacuucuccgaccuauacuaccucaccaugaacaacaaacacuggcugguccacaaagagugguuccacgacaucccccugccauggcacgcaggagccgacaccggcacaccccacuggaacaauaaagaagcucuaguagaguucaaggacgcacaugcaaaacgacaaaccgucgucguccuaggcucccaagaaggagcaguacacaccgcccucgcaggagcccucgaagccgaaauggacggagccaaagggcgacucuccucaggacaccuaaaaugucgccuaaaaauggacaagcuaaggcucaaaggaguaagcuacucccucugcaccgcggcauucaccuucacaaaaauccccgcugaaacacuccacggcaccgucacaguggaaguacaauacgccggaacagacgggccgugcaaaguaccagcccaaauggcggucgacaugcagacccucaccccagucgggcgccucaucacggccaacccaguaauuacggaaucaaccgagaacuccaaaaugaugcucgaacuggaucccccauucggcgacagcuacaucgucaucggcguuggcgaaaagaaaauaacacaccacuggcacagauccggcagcacacucggcaaagcguucucuacaacacucaaaggugcacaacgacuagcugcacucggcgacacagcaugggacuucggauccaucggcggagucuucaacuccaucgggagagcaguccaccagguuuucgggggcgccuuccgaacacuauucggagggaugagcuggaucacgcaaggacuaaugggagcccuccuacuauggaugggcguaaaugcaagagaccggagcauagcacucgccuuccuagcaaccggaggcguccucgucuuccuagccacaaacguccacgcg

SEQ ID NO: 9974 - RNA, 2085 nt, Artificial Sequence
  ZIKV (isolate Z1106033) prME-short variant CDS opt
auggccaucagcggcguccccguccuaggcuuuuucaucauugccguacucaugucagcccaagaaagcugggccguaacccgacgcggcagcgccuacuacauguaccuagaccgaaacgaugcaggggaagcaaucuccuuccccaccacgcuaggaaugaacaaaugcuacauucaaauaauggaccucggccauaccugcgacgccaccaugucauacgagugccccauguuagacgaaggaguagaacccgacgauguggauugcuggugcaacacaacaagcaccugggucguguacgggaccugccaccacaagaaaggagaagcgcgcagaucacgcagggcagucacgcuacccagccacucaacacggaaacugcaaacccgcucccaaacauggcuagagucacgggaauacaccaaacaccugauccgagucgaaaacuggaucuuuagaaacccaggauucgcccucgccgcagcugcuaucgccuggcuccucgggucaucaacaucccagaaaguuaucuaucucguaaugauccuccuaaucgcccccgccuacuccauccgcugcauaggagugaguaacagagacuucguggaaggcauguccggcgggacauggguagacgucguacucgaacacgggggaugcguaacagugauggcucaagauaaaccaacaguagacaucgaacucguuacgacaaccgucagcaacauggcagaaguccgaagcuacugcuacgaggcaagcauaagcgacauggccucagacagccgaugcccuacccaaggcgaagcauaccuagacaaacaaagcgacacccaauacgucugcaaaagaacgcucguggaccguggcuggggaaacggcugcggccuauucggaaaaggaagucugguaaccugcgccaaauucgcgugcuccaagaaaaugaccggcaaauccauccaaccugaaaaccucgaauaccggaucaugcuauccguccacggcagccaacacucaggcaugaucgucaacgacacaggacacgaaaccgacgaaaaucgagccaaaguagaaauaacacccaacagcccaagagcagaagcaacacuaggcggauucgggagccucggacucgacugcgagccacgcacagggcuagacuucucagaccucuacuaccuaaccaugaacaacaaacacuggcucguccacaaagaaugguuccacgacauaccacuccccuggcacgcaggggccgacaccggcacgccacacuggaacaacaaagaggcacuuguagaguucaaagacgcccacgcaaagcgacaaaccgucguaguucucggaucccaagaaggcgccguccacacggcccucgccggagcacuagaagcagaaauggacggcgccaaaggaaggcuaaguuccggccaccucaaauguagacucaaaauggacaaacuucgacuaaaaggagucagcuacagcuuaugcaccgccgcauucacauucacaaaaaucccagcagaaacacuacacggaaccgucacagucgaaguacaauacgcgggcacagacggcccauguaaggugcccgcccaaauggcaguggacaugcaaacccuaacccccguagggcgacucaucacggcaaacccagucaucaccgaaagcacagaaaacagcaaaaugaugcucgaacucgacccaccuuucggggacuccuacauagucaucggcgucggcgaaaagaaaauaacccaccacuggcacagaucaggcaguacccuuggaaaagccuucucaaccacuuuaaaaggugcacaaagacuagcugcacucggcgacaccgcaugggacuucggcucgauaggcgggguauucaacagcauaggacgagcgguccaccaagucuucggcggcgcauuccggacacuguucggaggaauguccuggauaacccagggacucaugggggcccuacuccucuggaugggaguaaacgcgagagaccgcuccaucgcccuagcauuccuagccacaggaggcguccuaguuuuccucgcaacaaacguacaugcc

SEQ ID NO: 9975 - RNA, 2073 nt, Artificial Sequence
  ZIKV (strain MR 766) prME-short variant CDS opt
auggccaucucagggguaccaguacuaggcuucuucaucauagccguccucaugucagcccaagaaucaugggcgauaacacgccgaggcagcgcuuacuauauguaucucgaucgaagcgacgccggaaaagccaucaguuucgcuaccacucuaggaguuaacaaaugccacguacaaaucauggaucugggccacaugugcgacgccaccaugagcuacgagugcccaaugcucgacgaaggaguagaaccggacgacgucgacugcuggugcaacaccaccaguacauggguugucuacggcacuugccaccacaagaaaggagaagcccgacgaucccgccgcgcggucacucuccccucccacuccacacgaaaacuccaaacccgcucacaaacguggcuagagucgcgagaauacaccaaacaccucauaaaaguagaaaacuggaucuuccgcaacccaggcuucgcacucguagcgguugcgaucgcguggcuccuaggcuccuccacuucccaaaaagucaucuaccuaguuaugauccuccuaaucgccccagccuacagcauccggugcaucggagucucaaacagagacuucgucgaagguaugagcggcggcacauggguagacgugguccucgaacacggcggaugcgucacaguuauggcgcaagacaaacccaccguagacaucgaacucgucacgaccaccgugucaaacauggccgaaguccgaagcuacugcuacgaagcaucaauaucagacauggccuccgacucccguugcccaacgcaaggagaagccuaccucgacaaacaaagcgacacccaauacguuugcaaacgcacccuagucgaccgcggcuggggcaacggaugcggccucuucggaaaaggcucccucgugacaugcgcaaaauucacaugcagcaagaaaaugacaggaaaaucaauccaacccgaaaaccucgaauacagaaucauguugucaguacacggcagccaacacucaggaaugauaggauacgaaacggacgaagaccgcgcaaaagucgaagucaccccaaacagccccagggccgaggcgacccuuggaggauucggcagccucggacucgacugcgagccccgcacaggccucgauuucagcgaucuauacuaccuuaccaugaauaacaaacacugguuaguccacaaagaaugguuccacgacauaccccuccccuggcacgcgggagcggacaccgguaccccacacuggaacaacaaagaagcacucgucgaguucaaagacgcccacgccaaaaggcaaacaguaguaguccucggaagucaagaaggcgccguccacaccgcacuggccggcgcccucgaagccgaaauggauggagccaaaggccgacucuucucaggacaccucaaaugccgacucaaaauggacaaacucagacuaaaaggaguauccuacagccuuugcacagccgccuucacguucacaaaaguccccgccgaaacacuucacggaacggucacagucgaaguacaauacgccggcaccgacggccccugcaaaauccccguucaaauggcgguggacaugcaaacucucacaccuguaggacgacuaauuaccgccaaccccgucaucacugaauccacagaaaacagcaaaaugaugcuagaacucgaucccccauucggcgacagcuacauaguaaucggugucggcgacaagaaaaucacacaccacuggcaccgcagcggcuccacacuuggaaaagcauuuucaaccacccucaaaggcgcacaaagacuagccgcgcucggagacacagcaugggacuucggcucgaucggcggagucuucaacuccauaggacgagccguccaccagguauucggcggagccuuccgcacacuguucggaggcaugagcuggaucacucaaggacucaugggagcgcuccuacucuggaugggcgucaacgcccgcgaccgaagcauagcuuuagccuuccucgccacaggaggcguccucgucuuccucgcgaccaacguacacgcc

SEQ ID NO: 9976 - RNA, 2085 nt, Artificial Sequence
  ZIKV (strain NatalRGN) prME-short variant CDS opt
auggcgaucuccggcguaccaguccuaggauucuucaucaucgcaguccucaugucugcacaagaaucaugggcaguaacaagacgcggguccgcauacuacauguaccucgaucgaaacgaugccggcgaagccauauccuuccccacaacacuaggcaugaacaaaugcuacauccaaaucauggaccuaggacacaugugcgacgcaacaauguccuacgaaugcccaaugcuggacgaggggguggaaccagacgacguagauuguuggugcaacacaaccuccaccugggugguauacggaacgugccaccacaaaaagggagaagcccgacgcagccgacgagccgugacccuacccucccacagcacacgaaaacuacaaacacgcagccaaacauggcuagaaagcagagaauacaccaaacaccuaauacgcguagaaaacuggaucuuccgcaacccaggcuucgcacuggccgcagccgccaucgcauggcuccucggcagcucaaccucccaaaagguaaucuaccuuguuaugauccuccuaaucgcaccggcguacuccauaagaugcaucggcgucucaaauagggacuucguagaaggcaugagcgggggaacguggguagacguaguccucgaacacggaggcugcguaaccgugauggcacaagacaaaccaacgguagacaucgagcuaguaacaacaaccgucuccaacauggcugaagucagauccuacuguuacgaagccagcauaagugacauggccucagacucacgcugccccacacaaggcgaagcauaccuagacaaacaauccgacacccaguacgucugcaagcgaacccucgucgacagaggcuggggcaacggauguggccuauuuggaaagggaagccucguaaccugcgcuaaauucgccugcucaaagaaaaugacaggcaaaagcauccaacccgaaaaccuggaauaccgcaucaugcuaagcguccacggcagccaacacucagggaugauaguaaaugauaccggacacgaaacagacgaaaaccgagcaaaaguggaaauaacaccaaacucgccacgggccgaagccacgcuagggggcuucggcucacuagggcucgauugcgagccaagaaccggacuagauuucagcgaccuauacuaucuaacgaugaacaacaaacauuggcuaguacacaaagaaugguuccacgacaucccccuaccauggcacgccggcgccgacaccggcacaccacacuggaacaacaaagaagcacucguggaguucaaagaugcccacgccaaaagacaaacagucgugguacuaggcagucaagaaggcgccgugcacacagcucuugcgggagcccuagaagccgaaauggacggcgccaaaggaagacuaagcuccgggcaccucaaaugccgacuaaaaauggacaaacucagacugaaaggcgucagcuacucacucugcacagcagccuucacauucaccaaaauucccgcagaaacacuacacggcacaguaaccgucgaaguccaauacgcaggcacagacggccccugcaaaguccccgcacaaauggccguagacaugcaaacacuaacacccguaggucgacuaauaaccgcgaacccagucaucacagaauccacugaaaacagcaaaaugaugcuagaacucgacccgccauucggagacucauacaucguaaucggagucggagagaagaaaauaacacaccauuggcaccgcucgggcuccacacuaggcaaagccuucagcacaacccucaaaggagcacaaagacuggccgcacucggcgacaccgcgugggacuucggcagcaucggaggcguguucaacucaauaggacgugccguacaccaagucuucggcggagccuuccgaacacuauucggcgggaugucauggauaacccaaggccuaaugggcgcccuacuccuauggaugggaguaaacgcacgggaccgcucgauagcacuagcuuuccucgcaacgggcggcguccuaguguuucuagcaacaaacguucacgcc

SEQ ID NO: 9977 - RNA, 2064 nt, Artificial Sequence
  ZIKV (strain ZikaSPH2015) prME-short variant CDS opt
auggacuggaccuggauacuauuccucguagccgccgccacccggguccauucagucacccgccgaggcucugccuacuacauguaucuggacagaaacgacgccggcgaagcaauuagcuucccaacaacccucggaaugaacaaaugcuacauacaaauaauggaccucggccacaugugcgacgcaaccaugucauacgagugcccaaugcuggacgagggagucgaacccgacgacguagacugcuggugcaacaccaccagcaccugggucguauacggcacaugucaccacaagaaaggggaagcccgacguagccgcagagcaguaacccuaccaagucauucaacacgcaaacuccaaacaaggagccaaaccuggcuagaaucacgggaguacacaaaacaccucauacgaguagaaaacuggaucuucagaaacccgggguucgcccucgcagccgccgccauagcauggcuucucgggucaagcaccucccaaaaaguaaucuaccucgucaugauacuacuaaucgcaccagcauacagcauacgaugcaucggcguaucaaacagagacuucguagaaggcaugaguggagggaccuggguugacauaguacuggaacacggcggaugcgucacagucauggcacaggacaaaccaaccgucgacauagagcuuguuacaaccacggucagcaacauggccgaaguccgaagcuacugcuacgaggcaagcauaucagacauggccucagacagccgaugcccaacgcagggagaagcauaccucgacaaacaaagcgacacgcaauacgucugcaaaaggacgcuuguagaccgcggcuggggaaacggaugcggccucuuuggaaaaggaucucuaguaaccugcgcaaaguucgcgugcucaaagaaaaugacuggaaaaucaauccaacccgagaaccucgaauaccgcaucaugcuauccguccacgggucacaacacagcggaaugaucguaaacgacacaggacacgaaacagacgaaaacagggccaaaguagagaucaccccgaacagcccaagagccgaagcaacacuaggcggcuucggcagucuuggacucgacugcgaaccgcggacuggacuggacuuuagcgaccuguacuaucucaccaugaacaacaaacacuggcuaguacacaaagaaugguuccacgacaucccgcucccauggcacgcaggcgccgauaccggaaccccucacuggaacaacaaagaagcccucguagaguucaaagacgcccacgccaaacgacaaacaguagucgugcucggaagccaagaaggagcgguacacacggcacucgcgggagcccuggaagcggaaauggacggcgcaaaaggacgacuaucaagcggucaccucaaaugccgacuaaaaauggacaagcuacgccucaaaggcgucagcuauagccuaugcacagccgcauucacauucacaaaaauaccggccgaaacacuacacggcaccgucaccgucgagguacaauacgcagguaccgacggacccugcaaagucccagcccagauggcagucgacaugcaaacccucaccccugucgggaggcuaaucaccgcaaaccccguaauuacagaaucaacagagaacagcaaaaugaugcuggaacuggacccacccuucggcgacuccuacaucgucaucggaguaggugaaaagaaaaucacccaccacuggcaccgaagcggcucaacccuaggcaaagccuucagcacaacccuaaaaggagcccaacgccucgccgcccucggcgauacggcgugggacuucggcuccauaggaggcguauucaauucaaucggccgcgccguacaccaagucuucggcggagcauuccggacacucuucggaggaaugagcuggauaacgcaaggacucaugggcgcauuacucuuauggauggggguaaacgcccgagaccguagcaucgccuuagccuuccucgccacaggcggagugcuaguauuccucgcaacaaacguccacgcc

SEQ ID NO: 9978 - RNA, 2064 nt, Artificial Sequence
  ZIKV (isolate Z1106033) prME-short variant CDS opt
auggacuggaccuggauacucuuccugguagccgcagcuacccgcguacacucagucacacgccgaggaucggccuacuacauguacuuagaccgcaacgacgcuggcgaagcaauaucauuccccacaaccuuaggcaugaacaaaugcuacauacaaaucauggaccugggccacacaugugacgcgaccauguccuacgagugcccaaugcuggacgaaggaguagagccggacgacguagacugcuggugcaacaccaccagcacauggguagucuacggaaccugccaccacaagaaaggcgaggcccgccgaagccgaagggcagucacccucccaagccacuccacccgaaaacuacagacccgcucccaaaccuggcuagaaucucgugaauacacaaaacaccucaucaggguagaaaacuggaucuuccgcaaccccggcuucgcacucgcagcagccgcaaucgcuuggcuacugggcuccuccaccucacaaaaaguaauauaccuggucaugauccuacugaucgccccagccuacagcauccgcugcaucggcguaagcaaccgggacuucguagaaggcaugucuggcgggaccuggguagacgucgugcuagagcacggcggcugcgucacaguaauggcacaagacaagcccacagucgacaucgaacucgucaccaccaccguaagcaacauggcagagguccgcuccuauugcuacgaggccagcauaucagacauggcaagcgacagccggugcccaacccaaggcgaagcauaccucgauaaacaauccgacacgcaauacguaugcaaacgaacacucgucgacagaggcuggggaaacggaugcggccuauucggaaaaggaucccuagucaccugugccaaauucgccugcaguaagaaaaugacaggcaaaagcauacaaccagaaaaccuagaauaccgaaucaugcucuccguacacggaagccaacacucaggaaugaucgucaacgacacugggcacgaaaccgaugaaaaccgugcaaaaguagaaauaacgcccaacucaccacgcgcagaagccacccugggaggcuucggcagccuaggacucgacugcgaaccaagaacuggccucgacuucucagaccucuacuaccucaccaugaacaacaaacacuggcucguacacaaagagugguuccacgacaucccccuaccauggcacgcuggggcggacacaggcacaccccacuggaacaauaaagaagcccuaguagaguucaaagacgcacacgcaaaacgacaaaccguagucguacuuggcagccaggaaggugcgguccauaccgcacuagccggcgcccucgaagccgaaauggacggcgcuaaaggucgccucucaagcggccaucuaaagugccgacuaaaaauggacaaacuccgucucaaaggagucuccuacagccugugcaccgcagcauucaccuucacaaaaaucccagcggaaacccuccauggaaccgugaccgucgaaguccaauacgcaggaacagauggacccugcaagguccccgcccaaauggcaguagacaugcaaacacugacccccgucggccgacucauaacggccaacccagucauaacugaauccacagaaaacucaaaaaugaugcuggagcucgacccgcccuucggcgauagcuacauagucaucggcgugggcgaaaagaaaauaacucaccacuggcaccgcagcggcaguacacuaggcaaagccuucaguaccacccugaaaggagcccaacgacucgcagcccucggagacacagcaugggacuucgguagcaucggcggcgucuucaacuccaucgggagagccgugcaccaaguguucggaggcgccuuccguacccucuucggaggaaugucauggauaacucaagggcucaugggcgcccuccuacucuggaugggaguaaacgccagagacagaagcaucgcccuagccuuccuagccaccggcggaguacucguauuccuggcaaccaacguccacgcu

SEQ ID NO: 9979 - RNA, 2052 nt, Artificial Sequence
  ZIKV (strain MR 766) prME-short variant CDS opt
auggauuggaccuggauccuguuccucguagccgccgccacacgcguacauucaauaacacgccgaggaucggcauacuacauguacuuggaccguagcgacgcaggcaaagcgaucuccuucgccacaacccugggcgucaauaaaugccacguacaaaucauggaccuuggacacaugugcgacgccacaaugucauacgaaugccccaugcuggacgagggcguagaaccagacgacgucgacugcuggugcaauaccacaagcacaugggucguuuacggcacaugccaccacaagaaaggggaagcgcgacggucccgacgagcggugacacuaccaucccacagcacacgcaaacuacaaacaaggagccaaaccuggcucgaaagccgagaguacacaaaacaccuaauuaaaguagaaaacuggaucuuccgcaauccaggauucgcgcuaguagcagucgccauagccuggcuacuaggaagcagcaccucccagaaagucaucuaucuagucaugauccucuuaauagcacccgcguacaguauacgaugcauaggcguaagcaacagggauuucguagaaggaaugucgggagggaccuggguagacgucgugcucgagcacggcgggugcguaaccguaauggcccaagacaaacccacagucgacaucgaacucguuacaaccacaguuagcaauauggccgaaguaaggucauacugcuacgaagcaucgaucagugacauggcaucagacucacggugccccacgcaaggcgaagcauaccuagacaaacaaagcgacacccaauacgucugcaaacgaacacucgucgaccgaggcuggggaaacgggugcggacucuucggcaaaggcucgcugguaaccugcgcaaaauuuacauguucaaagaaaaugacaggcaaaagcauucaacccgaaaaccucgaguaccgaaucaugcuaucaguccacggaagccaacacagcggaaugaucggguaugaaaccgacgaggacagagccaaaguagaaguaacgccaaacagcccccgggccgaagccacacugggcggauucggaagccucggccuggacugcgaacccagaacaggccuggacuucagcgaccuauacuaccuaaccaugaacaacaaacacuggcucguacacaaagagugguuccacgacaucccccucccauggcacgcaggagccgacaccggcacaccccacuggaacaacaaagaagcccuggucgaguucaaagacgcccacgcgaaacgacagaccguagucgugcuaggaagucaagagggggcaguacacacagcccucgccggagcacucgaggccgagauggacggcgcaaaaggacgccucuucucgggacaccuaaaaugccgccucaaaauggauaaauuaagacuaaaaggcgucucauacucguuaugcaccgccgcauucaccuucaccaaaguccccgccgaaacccuacauggaacaguaaccguggaaguacaguacgcggggaccgacggacccugcaaaaucccaguccagauggcggucgacaugcaaacccugacgcccgucggacgccuaauaacggcuaacccggugauaaccgaauccacagaaaacucaaaaaugaugcucgaacuagacccaccauucggagacagcuacaucguaauaggagucggcgacaagaaaaucacccaccacuggcaccgaaguggauccacacuaggcaaagcauucucaaccacacucaaaggggcccagcggcucgccgcccuaggagacacagcaugggacuucggaucaaucggagguguauucaacucgauaggcagagccguccaccaaguauucggaggggcauuccgaacacuauucgggggaaugagcuggaucacacaaggacucaugggagcccugcugcuuuggaugggcguaaacgccagagaccgaucaauagcccuagcauuccuugcaacaggaggcguccucgucuuccuagcaacaaacguacacgca

SEQ ID NO: 9980 - RNA, 2064 nt, Artificial Sequence
  ZIKV (strain NatalRGN) prME-short variant CDS opt
auggacuggacauggauccucuuucucguagcggccgcaacccgaguccacagcgugacccgccgcggcuccgccuacuacauguaccucgacagaaacgacgccggcgaggcaaucuccuucccgaccacccucggaaugaauaaauguuacauacaaaucauggaccucgggcacaugugcgacgcaaccaugagcuacgaaugccccaugcuggacgaaggaguagaaccagacgacgucgauugcuggugcaacaccacaagcaccuggguaguauauggcacaugucaccacaaaaagggggaagcccgccgcucacgccgcgccguaacacucccaucacacagcacccgcaaacuccaaaccagaucccaaaccuggcucgaaucaagagaguacacaaagcaccuaauacgcguagaaaacuggauuuucagaaacccaggcuucgcucuugcagccgccgcgaucgccuggcuccucggcuccaguacaagccagaaggucaucuaccucguaaugauccuccuaaucgcaccagccuacuccauacgcugcauagguguaucaaaccgagacuucguagaaggaaugagcggcggaacaugggucgacguaguacuagaacacggcggcugcgucacagucauggcacaggauaaaccaacggucgacaucgaacucguaaccacaacaguaagcaacauggcagagguccgaagcuacugcuacgaggccuccauauccgacauggcauccgacuccaggugccccacccaaggagaagccuauuuagacaaacaauccgacacccaauacgucugcaaaagaacacugguggaucgaggaugggggaacggcugcggauuauucggaaaaggaucacucguaaccugcgcaaaauucgcaugcagcaagaaaaugacaggcaaaagcauccagccggaaaaccucgaauaccgcaucaugcuaucaguacacggaucccaacacuccggcaugaucgugaacgacacaggacacgaaacggacgaaaaccgggccaaggucgaaauaacaccuaacucaccccgagccgaagcgacucucggaggguucgggagccucggccucgacugcgagccacgcaccggccuagacuuuucagaccucuauuaccucaccaugaacaacaaacacuggcuaguccacaaagaaugguuccacgacaucccacuaccuuggcacgccggcgccgacacaggcacaccccacuggaauaacaaagaagcacuggucgaauuuaaagacgcacacgccaaacgacaaacagucgucguacuaggaucacaagaaggagcaguucacaccgcccuagccggagcacuugaagcagaaauggacggagcaaaaggacgccuuagcucaggacaccuaaagugcaggcugaagauggacaaacugagacucaaaggagucuccuacucacugugcaccgcagccuucacauucacaaagauccccgcagagacucuccacggaaccgucaccgucgaaguacaauacgcaggaacagacggcccuugcaagguccccgcccaaauggcagucgacaugcagacacucaccccagucggaagacucaucacagccaaccccgucauaaccgaauccaccgaaaacucaaaaaugaugcucgaacuggacccacccuucggugacagcuacaucgucauagggguaggagaaaagaaaaucacacaccacuggcaccgcucaggauccacccucggaaaagccuucucaaccacacucaaaggcgcacaaagacucgcggcacucggagacaccgcgugggacuucggauccaucggcggcguauucaacagcauaggacgcgcaguccaccaaguauucggaggagccuuucgaacacucuucggcggaaugucauggaucacccaaggccuaaugggcgcccuacuccucuggaugggagugaacgcccgcgaccggagcaucgcacuagcuuucuuggcaacaggcggcguccuaguauuccuggccaccaacguacacgcc

SEQ ID NO: 9981 - RNA, 2082 nt, Artificial Sequence
  ZIKV (strain ZikaSPH2015) prME-short variant CDS opt
augggcaaaaggucagcgggcagcaucauguggcucgccucccucgcuguagugaucgccugcgcaggagcgguaacgcgccgaggcucagcauacuacauguaucuggaccgaaacgaugccggagaagcaauauccuucccaacaacacuaggcaugaacaaaugcuacauacaaauaauggaccuaggccacaugugcgacgcaacgaugucauacgaaugcccaaugcucgacgaaggcguugaaccagacgacgucgacugcuggugcaacacaacgagcacgugggucguauacggcacaugccaccacaagaaaggagaagcacgccggagccgucgggcagucacccugccaucccacuccacaagaaaacuccaaacacgaagccagacauggcucgagagcagagaauacaccaaacaccuaaucagagucgaaaacuggauauuccgaaaccccggguucgcgcucgcagccgccgcaaucgccuggcuacuaggaucaucaaccagccaaaaaguaaucuaucuaguaaugauacuacuaauagccccggcguacuccauaagaugcauaggcgucaguaaccgagauuucguagaaggaaugucaggagggacaugggucgacaucguacuagagcacggcggcugcgugaccguaauggcacaggacaaaccaacgguagacaucgaacucgucaccacaaccguaaguaacauggcagaagugagaucauauugcuacgaagccuccauaagcgacauggccagcgacucuagauguccaacgcaaggagaagcguaccucgacaaacaguccgacacgcaauacgucugcaaacgcacacucguggaccgcggcuggggaaacggaugcggacuauucggaaaagggucccuagucacaugcgcaaaauuugcgugcucaaagaaaaugacaggcaaauccauccagccagaaaaccuagaauacagaaucaugcucuccguacacggcucccaacacagcggaaugaucguaaacgacacaggacaugaaacggacgagaacagagcaaaagucgaaaucacgcccaauagcccacgcgccgaagcaacccuuggaggcuucggcagcuugggccuugacugcgaaccacgcacggggcuagacuucucagaccuauacuaccuaacaaugaacaacaaacacuggcucguccacaaagagugguuccacgacaucccccucccguggcacgccggcgcagauaccggcacaccccacuggaacaacaaagaagcccuagucgaguucaaagacgcacacgccaaaagacaaacagucgugguacuaggaucccaagaaggagcaguccacacagcgcuagcaggcgcccuagaggccgagauggauggagcgaaaggacgucuauccucaggacaccuaaaaugcaggcuaaaaauggacaaacuacgacuaaaaggcgucucuuacucacuaugcacagccgcauucacauuuaccaaaaucccagcggaaacacugcacggcacaguaaccguagaaguacaauacgcaggcaccgacggacccuguaaggucccagcccaaauggcagucgacaugcaaacacugaccccggucggacgccugauaacagccaacccaguaaucacagaaucgacagaaaauuccaaaaugaugcuagaacuagaucccccauucggcgacagcuauaucgugaucggaguaggggaaaagaaaaucacccaccacuggcaccgauccgggagcacgcucggaaaagcguucucaaccacacugaaaggggcacagcggcucgcagcacucggcgacaccgcaugggacuucgggucaaucggaggcgucuucaacuccaucggacgagcaguacaccaagucuucggaggcgcguucagaacauuauuugggggcaugagcuggaucacacagggccucaugggcgcccuacuccucuggaugggggugaacgccagagacagauccauugcacuagcguuccuagcaacgggcggcguacucguauuccuagccacaaacguccaugcc

SEQ ID NO: 9982 - RNA, 2082 nt, Artificial Sequence
  ZIKV (isolate Z1106033) prME-short variant CDS opt
auggggaaaagaucagcaggcuccaucauguggcucgccucacucgcaguagucauagcaugcgcaggcgcggucaccagacgaggcucagcguacuacauguaccuugacaggaacgacgcaggagaagccaucagcuucccgaccacacucggcaugaacaaauguuacauccaaaucauggaccuaggacauaccugcgacgccacaaugucauacgaaugcccaaugcuagacgaaggcguagaacccgacgacgucgacugcuggugcaacaccacgagcaccugggucgucuacggcacaugccaccacaagaaaggagaagcccgccgaucccgccgagcagucacccuccccagccacucuaccagaaaacuacaaaccagaagccagaccuggcucgaaucaagggaauacacaaaacacuuaaucagggucgaaaacuggauauuccguaacccaggguucgcccucgcggcagccgccauagcauggcuacugggcucgagcacuagccagaaaguaaucuaccucgucaugauauuacugaucgcaccagccuacucaaucagaugcauaggcguaagcaaccgcgacuucguagaagggaugucagguggaacaugggucgacgucguacucgaacacggcgguugcgucacaguaauggcucaggacaagcccacgguagacauagaacuuguaacaacaaccguaagcaacauggccgaaguacgcuccuacugcuacgaagccucaaucucagacauggcauccgacuccagguguccaacgcaaggggaagcguaccuagacaaacaauccgacacacaauacgucugcaaaagaacccuggucgaccgaggcuggggcaacggaugcgggcuauuuggcaaaggcucccuaguaaccugugccaaguucgcaugcuccaagaaaaugaccggcaaauccauacaacccgaaaacuuagaauacagaauaaugcuaucuguucacggaucccaacacagcgggaugauagucaaugacacaggacacgaaacagacgagaacagggccaaaguagaaauaacccccaacagcccacgcgcagaagcuacacugggcggauucggaucucuaggccuagacugcgaaccacgcaccggccuagacuucucagaccucuacuacuugaccaugaauaacaaacacugguuaguccacaaagaaugguuccacgacauaccacuccccuggcacgccggcgcagacacaggcaccccacacuggaacaacaaagaagcccucgucgaguucaaagacgcacacgcgaaacggcagaccgucguaguccucggaagccaagaaggagcgguccacacagcccuagcaggcgcacuagaagcagaaauggacggcgcgaaagggcgacuguccucagggcaccucaaaugucggcucaaaauggacaaacuacgccuuaaaggcguaucguacucacuaugcaccgcggccuucacauucaccaaaauccccgccgaaacacuacauggaaccguaaccgucgaaguacaauacgcaggcaccgaugggcccugcaaagucccugcacaaauggcagucgacaugcaaacacucaccccagucggccgacuaaucacagcuaaccccgugauaacggaguccacagaaaacucgaaaaugaugcucgaacuagacccgcccuucggcgacagcuacauaguuaucggagucggugaaaagaaaauaacccaccacuggcaccgaagcggaagcacccucggaaaagccuucuccaccacccucaaaggcgcccaaagacuagcagccuuaggcgacaccgcgugggacuucggaucuauaggcggaguauucaacuccauaggacgcgcaguccaccaaguauucgggggagcauucagaacacucuucggcgguaugagcuggaucacacaaggccucaugggagcacuccuacucuggaugggcgucaacgcaagggacagauccaucgcccucgcguuucuagcgaccgggggagugcucguauuccucgccacgaacguccacgca

SEQ ID NO: 9983 - RNA, 2070 nt, Artificial Sequence
  ZIKV (strain MR 766) prME-short variant CDS opt
augggaaaacgcagcgccggauccaucauguggcuagcaucgcucgcaguaguaaucgcgugcgccggugcaaucacacgacgcggcagcgcauacuauauguaccucgaccgaagugaugccgggaaggcgaucucauuugcaaccacgcuaggcguaaauaaaugccacguccagaucauggaccucggccacaugugcgacgccaccaugagcuacgaaugcccgaugcuggacgaaggcguggaacccgaugacgucgacugcuggugcaacacaacaagcaccuggguugucuacggcacgugccaccacaagaaaggcgaagcaagaaggucacgacgagcaguaacgcuaccaagccacagcacacgcaaacuacaaaccagaucacaaacauggcucgagagccgcgaauacaccaaacaccuuauaaaaguagaaaacuggauauucagaaacccgggauucgcccuaguagcaguagcaauagcauggcuacugggcucguccacgagucaaaaaguaauauaccuaguaaugauacuacugauagcacccgccuacucaauccggugcaucggaguauccaacagggacuucguagaagggaugucaggcgggacauggguagacgucguccuagagcacggcggaugcgucacgguaauggcccaagacaaacccacaguagauaucgagcuaguaaccacgaccguaagcaacauggccgaagucagaucguacugcuacgaagccagcaucagcgacauggccuccgacagccgcugcccaacccaaggggaagccuaccuagacaaacaauccgacacacaauacguaugcaaaaggacccuaguagauagaggguggggaaacggauguggucucuucggcaaaggcucccucguaacaugcgccaaauucacaugcagcaaaaagaugacaggcaagucaauacagccagaaaaccucgaguacagaaucaugcucucaguccacgguucacaacacagcggaaugaucggcuacgaaacggaugaagacagagcaaaaguggaaguaacaccuaacagcccacgcgcagaagcgacacuaggaggauucgggagucuaggauuggacugcgaaccaagaacaggccuagacuucagcgaccucuacuaccucacaaugaacaacaaacacuggcuaguccacaaggaaugguuccacgacauaccacuaccauggcacgcgggcgccgacaccggaacaccgcacuggaacaacaaagaagcccucgucgaguucaaagacgcgcacgcaaaacgacaaacgguaguaguccugggcucacaggaaggcgcaguacacacagcgcuagccggagcccuagaggcagaaauggacggcgcaaaaggccgccuguucagcggacaccuaaaaugcagacucaaaauggacaaacuacgccuaaaaggcgugucauacagccucugcacggccgccuuuacguucacaaaagugccagcagaaacacugcacggcacaguuacaguagaaguacaguaugccggaaccgacggcccaugcaaaaucccugugcagauggccguggacaugcaaacacugacaccgguaggacgacuaauaaccgcaaauccagugauaacggaaucaacagaaaacuccaaaaugaugcuggaacucgacccaccauucggcgacagcuacaucgugauaggcguaggagacaagaaaauaacacaccacuggcaccggaguggaagcacgcugggaaaagcauucagcacaacgcucaaaggcgcccagagacucgcggcacucggcgacaccgcaugggacuucggcucaaucggcggggucuuuaacagcaucggacgcgcagugcaccaagucuucggaggcgcguucagaacccucuucggaggcauguccuggauaacccaaggccucaugggcgcacugcuacuauggaugggggucaacgcgagagacagaagcauagccuuagccuuccuggccaccggaggaguacugguauuccuagcaacaaacgugcacgcg

SEQ ID NO: 9984 - RNA, 2082 nt, Artificial Sequence
  ZIKV (strain NatalRGN) prME-short variant CDS opt
augggaaaacggagcgcaggcuccauaauguggcuagcaagccuagccgucgugaucgcgugugcaggcgccgucacccggagaggcucggcguacuacauguaccucgaccgaaacgacgcaggagaggcaaucucauuccccacaacacucggaaugaacaaauguuacauccaaauaauggaccuaggccacaugugcgacgcaacaaugagcuacgagugcccaaugcucgacgagggaguagaaccagacgacgucgauugcuggugcaacacaaccagcaccugggucgucuacggaaccugccaccacaagaaaggcgaagcacgccgaagcaggcgcgcagucacucuaccgagucauagcacgcgcaaacuccaaacacgcagccaaaccuggcucgagagcagagaauacacaaagcaccucauccggguagagaacuggaucuucaggaacccaggguucgcccuagccgcagcagcaauagcauggcuccuuggaagcagcaccucacagaaaguaauauaccuaguaaugauucuccucaucgccccagcguacagcauaagaugcaucggagucuccaauagagacuucguagaaggcaugucaggaggcacauggguagacguaguccuagaacacggcggaugcgugaccguaauggcacaagacaaaccaacgguggauauagagcuggucacaaccacaguaagcaacauggcggaaguccggagcuacugcuacgaggcaucaaucagcgacauggcaagcgacagucgaugccccacccaaggcgaagccuaccucgacaaacaaagcgacacgcaauacguaugcaaacgcacacucgucgacaggggguggggaaacggcugcggacucuucggcaaaggcucacucguuaccugcgcaaaauucgcgugcuccaagaaaaugaccggcaaguccauccaaccugaaaaccuggaauaccgaaucaugcuaucgguccacggcagccaacacagcggaaugauagugaacgauacaggucacgaaacagacgagaacagagcaaaaguagaaauaacuccaaacucaccgcgagcagaagccacccugggcggcuucggaagccuaggccucgacugcgaaccccgcaccgggcuagacuuuagcgauuuguacuaccucaccaugaacaacaaacacuggcucguccacaaagaaugguuccacgacauaccccucccauggcacgcgggcgcagacaccggaaccccacacuggaacaacaaagaagccuuaguagaguucaaagacgcacacgcaaagcgacaaaccguagucgugcucggcucccaagaaggagccguacacaccgcacucgccggggcacuggaagcagaaauggacggcgcaaaaggaagacucucaucaggacaccuuaaaugccgacucaaaauggacaaacuaagauuaaagggagucagcuacagucucugcacggcggccuuuaccuucacaaaaauccccgccgaaacacuacacggaacagucaccguggaaguacaauacgcgggaacagauggaccaugcaaagugccagcccaaauggcagucgauaugcaaacccuaacccccguaggacgauugauaacagccaacccagugauaacagaaagcaccgaaaacagcaaaaugaugcuagaacuagaucccccauucggagacagcuacauagucaucgggguaggagaaaagaaaauaacccaccacuggcaccgaagcggcagcacacugggcaaagccuuuucuacgacgcucaaaggagcacaacgacucgcagcucucggagacacagccugggacuucggcaguauaggaggcguauucaacucgauagggagagcaguccaccaaguauucggaggagcauucagaacacuguucggaggcaugagcuggauaacacaaggacuuaugggcgcacuccuacuguggaugggagucaacgcuagagacagaucaauagcccuagccuucuuggccaccggcggaguacucguauuccuugcaacaaacgugcacgcg

SEQ ID NO: 9985 - RNA, 1785 nt, Artificial Sequence
  ZIKV (strain ZikaSPH2015) ME variant CDS opt
augacauccgugggaauagucggacuauuacucaccaccgcaauggccgcagucacccucccaagucacucuacccgcaaacuccaaacccgaucgcagaccuggcucgaaagccgcgaauacacaaaacaccucauccgagucgaaaacuggaucuuccgaaacccaggauucgcccucgccgccgccgcaaucgccuggcuccucgggagcucuacaucacaaaaagucauauaccucguaaugauacuacucauagcccccgccuauuccauccgcuguauaggaguaucaaaccgagacuucguagaaggcaugagcggcggcaccuggguagacaucguacucgaacacggaggcugcguaaccgucauggcacaagacaaacccaccguagacauagaacucgucacaacaaccguaucaaacauggcggaaguccgcuccuacugcuacgaagccucaaucagcgacauggccuccgacucacgcugcccaacacagggcgaggccuaccuagacaaacaaagcgacacccaauacguaugcaaacgcacacucgucgaccgaggcuggggaaacggcugcggccucuucggaaaaggaagccucguaaccugcgccaaauucgccugcuccaagaaaaugacuggaaaauccauacaaccggaaaaccucgaauacagaaucaugcucagcguccacggcucacaacacagcggcaugaucgugaacgacaccggacacgaaaccgacgaaaaccgcgcaaaaguagaaauaacuccaaacucaccacgcgcugaggccacacuaggcggcuucggcucccuagggcucgacugcgaaccaagaaccggucucgacuucucagaccucuacuaccucacaaugaacaacaaacacuggcuuguccacaaagaaugguuccacgacauaccccuccccuggcacgccggcgccgacacaggcacaccccauuggaacaacaaagaagcccucguggaguucaaagacgcgcacgcaaaacggcaaaccguaguagugcuagggucccaagaaggagccguccacacggcccucgcuggagcccucgaagcagaaauggacggcgcuaaaggccgacuguccucaggacaccucaaaugccgccucaaaauggacaaacuacgccucaaagguguuuccuacucacuaugcaccgccgccuucacguucaccaaaaucccagccgaaacccuccacggaacagucaccgucgaagugcaauacgccggcaccgacggccccugcaaagucccagcccaaauggcaguggacaugcaaacccuaaccccagucggccgccuaauuaccgccaaccccgucaucaccgaauccacagaaaacagcaaaaugaugcucgaacucgacccacccuucggcgacucguacaucgugauaggcgucggagaaaagaaaaucacacaccacuggcaccgcagcggcucaacaauaggcaaagcguucgaagccaccguccgcggcgccaaacgcauggccgugcucggcgacacagccugggacuucggauccgucgguggugcccuaaauagcuugggcaagggaauccaccaaaucuucggagccgccuucaaaagccuuuucggagggauguccugguucucccagauccucauaggaacccuacuaauguggcuaggccuaaacacgaagaacggcucaauaagccucaugugccucgcacuaggcggaguacuaaucuuccugucgacugccguauccgca

SEQ ID NO: 9986 - RNA, 1785 nt, Artificial Sequence
  ZIKV (isolate Z1106033) ME variant CDS opt
augaccagcgucggaauagucggccuccuccucacgacagcgauggcagccgugacacuccccucccacucgacaagaaaacuacaaacacgcucccaaacguggcucgaauccagagaguacacuaaacaccugauccgugucgaaaacuggauauuccgcaacccaggcuucgcccuggcagccgccgcaaucgccuggcuacucggcagcagcaccucacaaaaagucaucuaucuaguaaugauacuccugaucgcgccagcuuacuccauccgcugcauaggaguauccaacagagacuucgucgaaggcaugagcggaggcacaugggucgacgucguccuagaacacggaggaugcgucaccguaauggcacaagauaaacccacggucgacaucgagcuaguuaccacaacagucagcaacauggccgaaguccgcaguuacugcuacgaagccagcauaagcgacauggccucagacagcagaugcccaacccaaggcgaagccuaccucgacaaacagucagacacgcaauacguaugcaaaagaacccucguagaucgaggcuggggcaacggauguggacucuucgggaaaggcagccucguaaccugcgccaaauucgcgugcaguaagaaaaugacaggcaaauccauccaaccagaaaaccucgaauaccguauuaugcucuccguccacggcagccagcacuccggcaugaucguaaacgacaccggacacgagaccgacgaaaaccgagccaaagucgaaaucacccccaacucaccccgcgcagaagccacacucggcggcuucggcucccucggacuggacugcgaaccaaggacaggccuagacuucucagaccuauacuaccucacaaugaacaacaaacacuggcucgugcacaaagaaugguuccacgacaucccccuccccuggcacgccggagcagacaccggaacaccccacuggaacaacaaagaggcccuuguagaguucaaagaugcacacgccaagcgccaaaccguaguuguacugggaagccaagaaggcgcaguacacaccgcacuagcaggagcacuagaagccgaaauggacggcgccaaaggccgccuauccagcggccaccuaaaaugccgccucaaaauggacaagcucaggcugaaaggcgucagcuacucccucugcaccgcagcauucaccuucaccaaaauaccugcagaaacccuccacggcaccgucaccgucgaaguacaauacgcaggcacggacggcccaugcaaaguacccgcccaaauggccguggacaugcaaacccucacaccaguaggccgacucaucacagccaauccaguaaucacggaaagcacagaaaacaguaaaaugaugcuagaacucgacccacccuucggagacucuuacaucgucauaggaguaggcgaaaagaaaaucacccaccacuggcaucgcuccggcucaaccaucggcaaagcauucgaagccaccguacgcggcgccaaacguauggcuguccuaggagacaccgcaugggacuucggaucggucggcggcgcccucaacagccuaggaaaaggcauccaccaaaucuuuggagcggcguucaaaucccucuucggaggaaugucgugguucucccaaauacuaaucgguacgcuacuaauguggcucggccucaacgccaaaaacggaucaauuagccucaugugccuagcacuaggcggaguccuaaucuuccuaagcacagcgguaagcgcc

SEQ ID NO: 9987 - RNA, 1773 nt, Artificial Sequence
  ZIKV (strain MR 766) ME variant CDS opt
augaccuccaucggaauaauuggccuacuacucacaaccgcaauggcggccguaacccuucccucacacuccacucguaaacugcaaacccgcucccagacauggcucgaaucgagagaauacacaaaacaccuaaucaaagucgaaaacuggaucuuccgcaaccccggauucgcccuagucgccgucgcaaucgcauggcuccucggcuccucaaccagccaaaaaguuaucuaccucguaaugauccuccucaucgcacccgcauacucaauacgcugcaucggcgucucuaaccgcgacuuuguagaaggaaugucaggcggcaccugggucgacgucguacucgaacacgggggaugcgucaccgucauggcccaagacaaaccuacagucgacaucgagcuagucacgaccacagucucaaacauggcagagguaagaagcuacugcuacgaagccuccaucuccgauauggccuccgacucccgaugccccacacagggcgaagcauaccuagacaaacaauccgacacccaauacgucugcaaacgcacacucguagaccguggcugggggaacggcugcggacuauucggaaagggcucccucgucacaugcgcgaaauuuaccugcuccaagaaaaugaccggaaaaagcauacagcccgaaaaccucgaauaccgcaucaugcucuccgugcacggcagucaacacucaggcaugauaggcuacgaaacagaugaagaccgcgcaaaggucgaagucaccccaaacucccccagagccgaagccacccucgggggcuucggcagccucggacuagacugcgaaccuagaaccggccuagacuucagcgaccucuacuaccuaacgaugaacaacaaacacuggcuuguacauaaagaaugguuccacgacaucccccugcccuggcacgccggagccgacacaggaacaccgcacuggaacaacaaagaagcacucguugaguucaaagacgcccacgcaaaacgccaaacagucgucguacuaggaagccaagaaggcgccguccacaccgcacuagcaggagcauuagaagccgaaauggacggcgcaaaaggccgccucuucuccggccaccucaaaugccgacuaaaaauggauaaacuccgccucaaaggcgucagcuacucacucugcaccgccgccuucacauucaccaaaguccccgccgaaacacuacacggcaccguaacugucgagguacaauacgccggaacggacggcccuugcaagauacccguacaaauggcaguggacaugcaaacacucacccccgucggcagacuaauaacagccaacccgguaauaaccgaaagcaccgagaacucuaaaaugaugcuagaacucgacccacccuucggcgacagcuacaucgucaucggcgucggcgacaagaagaucacacaccacuggcacagaucagguuccacaaucggcaaggcauucgaagccacgguccgcggcgcaaaacgaauggccguccuaggcgauaccgccugggacuucggcuccgucggaggagucuucaacucccucggaaaaggaauccaccaaaucuuuggagccgccuucaaaucgcuauucggcggcaugagcugguucagccagauccuaauagguacacugcucguauggcucggcuuaaauaccaaaaacggaagcaucucccuaacgugccucgcccucggcggcgucaugaucuuccucuccacagccgugagcgca

SEQ ID NO: 9988 - RNA, 1785 nt, Artificial Sequence
  ZIKV (strain NatalRGN) ME variant CDS opt
augacaagcguaggcauagucgggcuccuacuuacaacagccauggcagccguaacauuaccaucacacuccacccgcaaacuacagaccagaucccaaaccuggcucgaaagccgcgaauacacaaaacaccucauacgcgucgaaaacuggaucuucagaaaccccggguuugcccuagcagccgcagcaauagccuggcugcugggaagcuccacaucacaaaaggucaucuaccuaguaaugauccugcucauagccccagccuacuccauccgcugcauaggcgucagcaaccgcgacuucguagaagggaugucaggcgguacauggguagacgucguacucgaacacggaggaugcgucaccguaauggcgcaggacaaaccaacaguagacaucgaacucgucacaaccaccgucucgaacauggccgaagugcgaagcuacugcuaugaagcauccaucucagacauggcguccgacagccgaugccccacccaaggagaggcauaucucgacaaacaaagcgacacccaauaugugugcaaacgcacccucguggaccgcggauggggaaacggaugcggccuguucggaaaaggcucacucguaacaugcgcaaaauucgcaugcagcaagaaaaugaccggaaaaagcauacagccugaaaaccuagaauacagaauaaugcugagcguccacggcucacaacacuccggcaugauaguaaacgacacaggccacgaaaccgacgaaaacagagccaaaguagaaaucacaccaaauuccccacgagcagaagccacacucggcggcuucggcagccuaggccuagacugcgaaccacggacaggacuagacuucagcgaccucuacuaccucacaaugaacaacaaacacuggcugguccacaaagaaugguuccacgauauaccccuccccuggcacgccggagcagacaccggcaccccacacuggaacaacaaagaagcacuggucgaguucaaagacgcucacgcgaaacgccagacagucgucguacugggcagccaagaaggcgccguccacaccgcucucgccggcgcacuagaagcggaaauggacggggcaaaaggccggcuaucaagcggccaccugaaaugccgacucaaaauggacaaacuacgacugaagggcgucagcuacagucuaugcacagccgcauucaccuucacaaaaauccccgcagaaacccuacacggcacagucaccgucgaagugcaauacgccggcacagacggacccugcaaaguccccgcucagauggccgucgacaugcaaacauuaacccccgucggacgacuaauaaccgcaaacccaguaaucaccgaauccacagagaacuccaaaaugaugcucgaacucgaucccccauucggcgacagcuacauaguaaucggcguaggagaaaagaaaauaacgcaccacuggcaccgaagcggcuccaccauaggcaaagcauucgaagcgaccguccgcggagccaaacgcauggcagucuuaggcgacaccgcaugggacuucggcuccgucggcggcgcccuaaacagccucggaaaaggaauccaccaaaucuucggcgccgcauucaaaagccuauucgggggcaugucaugguucucccaaauccugauaggaacccuacucauguggcuagggcugaacaccaaaaacggcagcauaagccuaaugugccuagcacuaggcggaguccucauauuucucucaacagccgucucggcc

SEQ ID NO: 9989 - RNA, 1812 nt, Artificial Sequence
  ZIKV (strain ZikaSPH2015) ME variant CDS opt
auggccauaucaggcgucccuguccucggcuucuucaucaucgccguacuaauguccgcccaagagucaugggccgcagugacccucccaagccacagcacgcgcaaacuacaaacccgcagccagaccuggcucgaaagccgagaauacaccaaacaccuaauaagagucgagaacuggaucuuccgcaaccccggauucgcgcucgcggccgccgccaucgcauggcuccuaggcagcuccaccucacaaaaagucauauaccucgugaugauccuccuuaucgcccccgccuacuccauccgaugcaucggagucagcaaccgagacuucgucgaaggaaugucaggcggcacaugggucgacauaguccucgaacacggcggaugcgucaccguaauggcccaagacaaacccacagucgacaucgagcuagucacaaccacaguaucaaacauggcagaaguaagaagcuacugcuacgaagccuccaucucagacauggccucggacucacgaugccccacgcagggagaagccuaccuggacaaacagucugacacacaauacgucugcaaaagaacccucguagaccgcggauggggcaacggcugcggacuauucggaaagggcucccuaguaaccugcgcaaaauucgcaugcucgaagaaaaugaccggcaaaucaauucaacccgagaacuuagaauaccgcauaaugcucucaguacacggcucacaacauagcgggaugaucguuaacgacaccggccacgaaacagacgaaaaccgagcgaaagucgaaauaacaccaaacagcccacgcgcggaagccacccugggcggcuucgggucccucggcuuagacugcgaaccgcgaacaggacuagacuuuagugaccucuacuaccucaccaugaacaacaaacacugguuaguacauaaagaaugguuccacgacaucccacugcccuggcacgccggcgccgacaccggcacaccccacuggaacaauaaagaagcccucguagaguucaaagacgcccacgcgaaacgacaaacagucgucguacuaggcagccaagaaggcgcuguccacaccgcucucgccggagcacucgaagccgaaauggauggagcgaaaggacgacuaagcuccggccaccucaagugccgacucaaaauggacaagcuccgccugaaaggcgucaguuacucccuuugcacugcagcauuuaccuuuacgaaaauacccgccgaaacucuacacggaaccgucacaguagaaguccaauacgccggcacagacggaccaugcaaggucccagcccaaauggccgucgacaugcaaacacuuaccccaguaggaagacuaauaacagccaaucccguaaucacagaaucuaccgagaacucaaaaaugaugcucgagcucgaucccccauuuggcgacagcuacaucgucauaggggucggcgaaaagaaaaucacacaccacuggcaccgcagcggcagcacaauaggcaaagcauucgaagccacagucagaggcgcaaaacguauggcgguacugggcgacacagccugggacuucggaaguguaggcggagcacuaaacucguuaggcaaaggcauacaccaaauauucggagcagccuucaaaagccuguucggcggaaugucaugguucucgcaaauccuaaucggcacucuccucaugugguuaggccucaacaccaaaaacgggagcaucagccuaaugugccucgcacucggaggagugcucaucuuccuaagcacggcagucuccgcc

SEQ ID NO: 9990 - RNA, 1812 nt, Artificial Sequence
  ZIKV (isolate Z1106033) ME variant CDS opt
auggccaucagcggcguccccguacucggauucuucaucaucgccguacuaauguccgcccaagaaagcugggcagccgugaccuuaccaucacacucaacuagaaaacuccaaacacgcucccaaaccuggcucgaaucuagagaguacaccaaacaccucauccgaguagaaaacuggaucuuccgaaacccaggauucgcacuugccgcagccgcgaucgcauggcugcucggaagcucuaccucacaaaaaguaauauaccuagucaugauucuccuuaucgcccccgcauacagcauacgcugcaucggagucuccaacagagacuucgucgaaggcaugagcggcggcacauggguagacguaguccucgaacacggaggaugcgucaccguaauggcccaagacaaacccaccguagacauagaacuggucacaacaaccgucucaaacauggccgagguaaggagcuacugcuacgaagccuccaucuccgacauggcaagcgacagucgcugcccaacccaaggagaagccuaccuagacaagcaaagugacacccaauacguaugcaaacgaacccucgucgaccgaggauggggaaacgggugcggccuauucggaaaaggaagccucgucacgugcgcaaaauucgcaugcagcaagaaaaugacaggcaaaagcauccaacccgaaaaccucgaguacagaauaaugcuaagcgugcacggcucacaacacuccggcaugaucguaaacgacacaggacacgaaaccgacgagaaccgagccaaagucgaaaucacccccaacucaccacgcgccgaagcaacccucggcggauuugguucccucggacuagacugcgaaccaagaaccggacucgacuucuccgacuuauacuaccuaaccaugaacaacaaacacuggcuaguacauaaagaaugguuccacgacaucccacuacccuggcacgcgggcgcggacaccggcaccccacacuggaacaacaaagaagcacucguagaauuuaaagacgcacacgccaaacgccaaacagugguagugcuaggaucccaggaaggagccguccacaccgcacucgcaggggcccuugaagccgaaauggacggagcgaaaggccgccuuucgagcggacaccucaagugccgccuaaagauggacaaacuccgacucaagggaguaagcuacucccucugcacagcagcauucacauucacaaaaauacccgccgagacacuucacggcaccgucaccgucgaaguccaguaugccggaaccgacggacccugcaaaguaccagcucaaauggccguagacaugcaaacccuaacgcccgucggacgacuaauaacagcgaacccggucaucaccgaaucaaccgaaaacagcaaaaugaugcucgaacuagaucccccauucggagacagcuacauaguaaucggcguaggagaaaagaaaaucacgcaccacuggcaccgcucaggaucaaccauaggaaaagcguucgaagcaaccgugcgcggcgcuaaacgcauggcaguccucggcgacaccgccugggacuuuggaucagucggaggagcccucaacagccucggcaaaggcauacaccaaaucuucggagcagccuuuaaaucccucuucggaggcaugucgugguucagccaaauacuaaucgggacccuacuaauguggcuaggacucaacgccaaaaacggcagcauaucccucaugugccuagcccucggcggaguccucauauuucuaucaacagccgucucagcu

SEQ ID NO: 9991 - RNA, 1800 nt, Artificial Sequence
  ZIKV (strain MR 766) ME variant CDS opt
auggcgauauccggagucccaguccucggcuucuucaucaucgcaguccugaugucagcgcaagaaagcugggcagcggucacacuacccagccacuccacacgcaaacuccaaacacgcagccagacauggcuagaaucccgcgaauacacaaaacaccucaucaagguagaaaacuggaucuuccgaaaccccggauucgcgcucgucgcuguagcaaucgcauggcuacucggcagcucgacaucgcaaaaagucaucuaccuagucaugauccuacucaucgcacccgccuacuccauaagaugcaucggcgucuccaaccgagacuucguagaaggaaugucaggcggcaccugggucgacgucguccuagagcacggaggcugcguaaccgucauggcacaggacaaaccaacagucgacauagaacucguaacaaccaccguaucaaacauggccgaaguccguucauacuguuacgaagccucaauaagugacauggccucagacagccgaugccccacccagggggaggcauaccuggacaagcaaucagacacccaauacgucugcaaaagaacgcucguagaccgcggcugggguaacggcugcgggcuauucggcaaaggcucccucgucacgugcgccaaauucacgugcagcaagaaaaugaccggaaaaagcauccaaccugaaaaccucgaauaccgaauaaugcuguccguccacggcagccaacacagcggcaugaucggcuacgaaaccgacgaagaccgcgcaaaagucgaagucacacccaacucaccacgcgcggaagccacacugggaggauucggaagccuaggacuagacugcgaaccacgaacaggacucgacuucagcgaccuuuacuaccucaccaugaacaacaaacacugguuaguccacaaagaaugguuccacgacaucccccuccccuggcacgccggagccgacacaggaacgccccacuggaacaacaaagaagcccucgucgaguucaaagacgcgcacgcaaaaaggcaaaccgucgucguucuaggaucacaagaaggcgcgguacacaccgcgcuagccggcgcccuagaagccgaaauggacggugccaaaggucgccucuucucaggacaccucaaaugccggcugaaaauggacaaacuccgccuaaaaggcguauccuacagccucugcaccgcagccuucaccuucacaaaagucccugccgaaacccugcacggcaccgucaccgucgaaguccaauacgccggaacggauggccccuguaaaauccccguacaaauggccguagacaugcaaacccucacgcccguaggccgacucaucaccgccaacccagucauaacagaauccaccgaaaauagcaagaugaugcuagaacucgaucccccauucggagacucauacauagucaucggagucggcgacaaaaagauaacacaccacuggcaccgcucaggcucaaccaucggcaaagccuucgaagccaccguccgcggcgcaaaaagaauggcaguccucggagacaccgcaugggacuucggcuccguaggaggcguauucaauagccuaggcaagggcauucaccaaauauucggggcagccuucaagagcuuauucggcgggaugucaugguucucccaaauacucaucggaacacuccuaguguggcucggccucaacacaaagaacggcucaaucagccuuaccugccucgcacucggaggcgugaugauauuccuauccacagccguauccgcc

SEQ ID NO: 9992 - RNA, 1812 nt, Artificial Sequence
  ZIKV (strain NatalRGN) ME variant CDS opt
auggcaauauccggcgugcccguacucggauucuucaucaucgccguccucaugucagcgcaagaauccugggcagccguaacacuccccucccacagcacccgcaaacuacaaacaagaagccaaaccuggcuagaaucacgagaauacaccaagcaccuuauaagagucgaaaacuggauauuccgaaacccaggauucgcacuggcggccgcagcaauagcauggcuccuaggcucgaguacaagccaaaaaguaaucuaccucguaaugauccuacuaaucgcacccgcguacucaaucagaugcaucggcgucagcaacagagacuucguagaaggaauguccggagggacuugggucgacguaguacuagaacacggcggcugcgucacaguaauggcacaagacaaaccaaccgucgacauagagcuagugaccacaaccgucagcaacauggcggaaguacgcagcuacugcuacgaagcaagcauaucggacauggcaagcgacagccgcugcccaacacagggcgaagcauaccuagacaaacaauccgacacccaauacguuugcaagcgaacacucgucgaccgcggcuggggcaacggcugcggccuauucggcaaaggcucccuaguaacaugcgcaaaauucgcaugcucuaagaagaugacaggcaagagcauacaaccagaaaaccucgaauacaggaucaugcuaucgguccacgguucacaacauucaggcaugaucgucaaugacacgggacacgaaaccgacgaaaaccgcgccaagguggaaauaacgcccaacaguccccgcgccgaggcaacccugggcgguuucggcagccucggccucgacugcgaaccaagaaccggacucgacuucagcgaccuauacuaccuaacuaugaacaacaagcacuggcuuguccacaaagagugguuccacgacauaccccuccccuggcacgcaggagcagacaccggaaccccacacuggaacaacaaagaagcacucguagaguucaaagacgcccacgcgaaaagacaaacagucgugguacuggggagccaagaaggugccguccacacagcccuagccggagcacucgaagcagaaauggacggcgcaaaagggcgccucucaucaggccaccuaaagugccgacuaaaaauggacaaacuccgccuaaaaggcguaucuuacucccuaugcaccgccgcauucaccuuuacaaagauaccggccgaaacccuccacggcaccguaacaguagaaguccaauacgccggcaccgacggccccugcaaaguccccgcccaaauggcaguagacaugcaaacacuaacacccgucggccgacucauaaccgccaaccccgucauaacagaaaguacugaaaacuccaaaaugaugcucgaacucgacccacccuucggagacagcuacauagucauaggcgucggcgagaaaaagauaacccaccacuggcaccgcuccggcuccacaauaggcaaggccuucgaagccaccguaagaggcgcaaaacgcauggcaguccugggagacacagcaugggacuucggcuccguuggaggggcacuaaacucacuagggaaaggcauacaucaaauuuucggcgcagccuucaaaagccuauucggcggaaugagcugguucagccaaauacuaaucggcacacuacuuauguggcucggccucaacacgaaaaacggaagcaucucccuaaugugccuagcacucggcggcgugcuaauauuccuaagcacagcagucagcgca

SEQ ID NO: 9993 - RNA, 1791 nt, Artificial Sequence
  ZIKV (strain ZikaSPH2015) ME variant CDS opt
auggacuggacauggauacuauuccucguagcagcagcgacaagagugcacagugcaguaacccuccccucacacagcacgagaaaacuacagacgcgcagccaaaccuggcucgaaucacgagaauacaccaaacaccuaauacgagucgagaacuggauauucagaaaccccggcuucgcccuagcagcagcagcaaucgccuggcuccuaggcagcagcacaucacaaaaagugauauaccugguaaugauccuucuuauagcccccgccuauaguauaagaugcaucggcgucagcaaucgcgacuucgucgaaggaaugucgggaggaaccugggucgacauaguucuagagcacggaggcugcgucaccguaauggcacaagacaaaccaacaguggacaucgaauuaguuaccacaacgguaagcaacauggccgaagucagaagcuauugcuacgaagcaagcauaucagacauggcaagcgacucccgaugccccacccaaggcgaggcuuaccuagacaaacagagugacacccaguacgugugcaaaagaacccuagucgaccguggcuggggcaacggaugcggacucuucggcaaagggagccucguaacaugcgcaaaauucgcuugcucaaagaaaaugaccggcaaaagcauccaaccagaaaaccuagaauaccgaaucaugcucuccguacacggaucacaacacagcggaaugauagugaacgacaccgggcacgagacagacgagaaccgcgccaaaguagaaauaacccccaacagucccagagccgaagcgacacuaggaggauucggaucauuagggcuggacugcgagccacgaaccggccuagacuucucagaccuauacuaccucacgaugaacaacaaacacuggcucguacacaaggaaugguuccacgacauaccccuaccauggcacgccggcgcagacacaggcacaccccacuggaacaauaaagaagcccucgucgaauuuaaagacgcccacgccaaacgccaaacaguggugguacucggcucacaagaaggugccguucacacggcccuagcaggcgcccuggaagccgaaauggacggagccaaaggucgacuaagcagcggacaucuaaaaugcagacugaaaauggacaaacuccggcucaaaggaguaucauacagccuaugcaccgccgccuucacguucacaaaaauaccagcagagacccuccacggcacagucacgguagaaguccaauacgccggcaccgacggccccugcaaagugccagcacaaauggcagucgacaugcaaacccugacacccgucggcaggcuaaucaccgcaaaccccgucaucacagagaguacagagaacagcaaaaugaugcucgaacucgacccacccuucggagacucguacaucgucauaggcgucggcgaaaagaaaaucacccaucacuggcauagaagcggaagcaccauaggcaaagccuucgaagccaccguacgcggggccaaacgcauggccguccucggagacacagcgugggacuucggcucgguaggcggcgcacucaacucacucggcaaaggcauacaccaaaucuucggcgcagccuucaaaucccuauucggcgggaugagcugguucucgcaaauacuaauaggcacccugcuaauguggcucggacuaaacaccaaaaacggcucgaucucauuaaugugccuagcgcucggcggaguacuaaucuuccuaucaacagcaguaucagcc

SEQ ID NO: 9994 - RNA, 1791 nt, Artificial Sequence
  ZIKV (isolate Z1106033) ME variant CDS opt
auggacuggaccuggauccucuuccucguagccgccgccacacgcguacacagcgcagucacacucccgagccacagcaccagaaaguuacaaacacgcucucaaacguggcuagagucccgagaauacacaaaacaccuaauacgcguagaaaacuggaucuucagaaacccagguuucgcccuggcggcagccgccaucgcguggcuacucggcucaagcaccagccaaaaagucaucuaccucgucaugauccuacucauagccccagccuacuccauccgaugcaucggagucuccaauagagacuucguggagggaaugagcggcgguaccugggucgacguuguccuagaacacggcggcugcgucaccguuauggcccaagacaaacccaccgucgacauagaauuagucaccacaacagucucaaacauggccgaaguccgaagcuacuguuacgaagccuccaucuccgacauggccagcgacucacggugcccgacccaaggcgaggcuuaccucgacaaacaaucagacacacaauacgucugcaaacgcacacucgucgacagaggcuggggcaacggcugcggccuguucggcaaaggcucccuaguuaccugcgcuaaauucgcaugcagcaagaaaaugaccggcaaaagcauccagcccgaaaaccuagaauacagaaucaugcucucaguccacggaagccaacacagcggcaugauagucaacgacaccggccacgaaaccgacgaaaacagagccaaagucgaaaucacccccaacucaccccgcgcggaggccacacuuggcggauucggcucccuaggacuggacugcgaaccccgcaccgggcuagacuucuccgaccuauacuaccucacaaugaacaacaaacacuggcuaguccacaaagaaugguuccacgacauaccauuacccuggcaugccggcgcagacacaggaacaccccacuggaacaacaaagaagcacucgucgaguucaaagacgcccacgccaaacgccaaaccgucgucgugcuaggaucccaagaaggugccguacacaccgcccuugcaggggcucucgaagccgaaauggacggcgccaagggacgccuuuccuccggccaccugaaaugccggcucaaaauggacaaauuacgacucaaggguguaucauacucccucugcaccgcagcauucaccuucaccaaaauccccgccgaaacgcuccauggcaccgucacagucgaaguucaauacgccggcaccgacggacccugcaaggugccggcgcaaauggccgucgacaugcaaacccuaacgcccguagggaggcucaucacugccaacccaguaauaacagaaagcacagaaaacuccaaaaugaugcucgaacucgacccgcccuucggggacucauacauaguaauuggcguaggcgaaaagaaaauaacacaccacuggcacagaagcggaucaacaauaggaaaagccuucgaagcaacgguaagaggggccaaaagaauggccguacucggagacaccgccugggacuucggcucaguugggggugcacuaaacucccucggcaaagguauccaccaaauauucggcgcugcauucaaaucacucuucggaggaaugucaugguucucccagauacucauaggcacccugcucauguggcucggccucaacgcgaaaaacgguagcauuucacuaaugugccucgcauuaggcggagugcucauauuccuaucaaccgcagucagcgcc

SEQ ID NO: 9995 - RNA, 1779 nt, Artificial Sequence
  ZIKV (strain MR 766) ME variant CDS opt
auggauuggaccuggauacucuuccuagucgcagcagcaaccagaguacacucagccguuacccuccccagccacucaacaagaaagcugcaaacacgcagccaaacguggcuagaaucccgcgaauacacgaaacaccucauaaaggucgaaaacuggaucuucagaaacccaggcuucgcgcucgucgcggucgccaucgcauggcuacucggguccagcacuucccaaaaagucauauaccuagucaugauccuacucaucgcacccgcuuacagcauccgcugcaucggaguauccaaucgagacuucguagaaggcaugagcggaggcacauggguagacguaguccucgaacacggcggaugcgucaccguaauggcgcaagacaaacccaccguagacaucgaacucguaacaacaaccgucucgaacauggcagaagucagaagcuacugcuacgaagcaagcauaagcgacauggcgagcgacucccgcugccccacccaaggggaagccuaccuggacaaacaaagcgacacccaauacguaugcaaacgaacacucguagauagaggcuggggcaacggaugcggccuauucggaaagggaucccuagucacaugcgcaaaauucacaugcucaaagaaaaugacaggcaaaucaauacaacccgaaaaccucgaauaccgcaucaugcucagcguccacggaucacaacacucgggaaugauaggauacgaaacggacgaagaccgggcaaaaguagaggucacaccaaacuccccaagggcggaagccacccucggcgguuucggcucacuggggcuagacugcgaaccccgcaccggacucgauuucucagaccuauacuaccucacaaugaacaacaaacacuggcucgugcacaaggaaugguuccacgacauaccccucccguggcacgccggcgcggacacaggaacaccccacuggaacaauaaagaagcacucgucgaguucaaagacgcacacgccaaacgccagaccguaguaguacucggaucacaagaaggggccguacacacggcgcuggccggagcacuagaagcagaaauggauggcgcaaaaggccggcuauucaguggacaccuaaaaugucgccuaaaaauggacaaacucagacucaaaggagucuccuacucccuaugcacggccgcguucacauucacaaaaguccccgcagaaacacuccacggcacgguuacagucgaaguccaauacgcaggcaccgacggccccuguaaaauaccuguacaaauggccgucgacaugcaaacacucacacccgucggaagacugaucacugcaaacccagucauaacagaaaguacagaaaacagcaaaaugaugcuagaacuugacccacccuucggcgauucguacaucgucaucggcguaggagacaagaaaaucacccaccacuggcaccgaagcggcagcaccauaggaaaagcauucgaagcaacaguacgcggagccaaaagaauggccguccuuggagacacagccugggacuucggguccgucggaggcguauucaacagccugggaaaaggcauccaccagaucuucggcgcagcauucaaaucgcuauucgguggaauguccugguucagccaaauccuaaucgggacccucuuaguguggcuaggacuaaacacgaaaaacggcagcaucagccuaaccugccuagcccugggaggggucaugaucuuccucucaacugcagucucagca

SEQ ID NO: 9996 - RNA, 1791 nt, Artificial Sequence
  ZIKV (strain NatalRGN) ME variant CDS opt
auggacuggacguggauacucuuccucguagcagcggccacaagaguccacagcgcaguaacacugcccucacacucuacccgcaaacugcaaacacgcagccaaacauggcuagaaucacgcgaguacacaaaacaccugauccgagucgaaaacuggauauucagaaacccaggauucgcccuggcagcggccgccauagccuggcuacucggaagcucuaccucacaaaagguaauauaccuaguaaugauccuccucaucgcccccgccuacucaauacgcugcaucggaguaagcaaccgcgacuucgucgaaggaaugagcggaggaaccuggguggacgucgucuuagagcacggaggaugugucacgguaauggcccaagacaaacccaccgucgacauagaguuggucaccacaacagucuccaacauggccgaggucagaagcuacuguuacgaagcaaguaucucagacauggccagcgacagccgcugcccaacacaaggagaagcauaccucgacaagcaaagugacacacaauacgugugcaagcgcacgcuaguagaccgaggcuggggaaacggcugcggccucuucggaaaaggcagccucguaacaugcgccaaauucgccugcuccaaaaagaugaccggcaagucgauccaacccgaaaaccucgaauacagaaucaugcuauccguacacggaagccaacacucaggcaugauagucaacgacacuggacacgaaaccgacgaaaaccgcgccaaaguagaaaucacaccaaacucaccacgagcagaagcaaccuuaggaggauucggcucccuaggacucgauugcgagcccagaacagggcuggacuucucagaccuauacuaccuaacaaugaacaacaaacacuggcuaguacacaaagaaugguuucacgacauaccacuaccauggcacgcuggugcagacacgggaacgccccacuggaacaacaaagaagcacucguagaguucaaagacgcacacgcaaagagacaaacaguugucguccuaggaagccaagaaggcgccguacacacggcccucgccggagcucucgaagccgaaauggacggagcuaagggaagacucagcagcggccaccuaaaaugccgacuaaaaauggacaaacuccgacucaagggaguaagcuacucacuaugcacggccgccuucacauucacaaaaauacccgccgagacccuccacggaaccgucaccgucgagguacaguacgcaggaaccgacggacccugcaaaguacccgcgcagauggcaguagacaugcaaacacucacccccgugggacgccucauaaccgcgaacccagucauaaccgaguccacggaaaacagcaaaaugaugcuagaacuugacccaccauucggagacuccuacaucguaauaggcgucggcgaaaagaaaaucacacaccacuggcaccgaucaggcucgaccaucggaaaagccuucgaagcaacaguacgcggcgccaaacgcauggcaguccucggagacacggccugggacuucggcucaguagggggcgcacucaacagucuaggaaaaggcauacaccagaucuuuggggcagccuucaaaagccuauucggcggaaugagcugguucagccaaaucuuaaucggaacacuacuaauguggcucggccuaaacaccaaaaacggauccaucagccuuaugugccuugccuuaggaggcgugcuaauauuccugagcacagcuguaagcgca

SEQ ID NO: 9997 - RNA, 1809 nt, Artificial Sequence
  ZIKV (strain ZikaSPH2015) ME variant CDS opt
auggguaaaagauccgccggcagcauaauguggcuggccucccucgccgucgugauagcaugcgcaggcgccgcagucacacuccccagccacagcaccagaaaacuacaaacccgcucccaaaccuggcuagaaucaagagaauauacaaaacaccucauaagagucgaaaacuggauauuccgaaaccccggcuucgcacucgccgccgcagcaauagccuggcuccucggcucuagcacgucacaaaaggucauauaucuagucaugaucuugcuaaucgccccagcauacuccauccggugcauaggcguuuccaaucgggacuucguagaaggcauguccggcggaaccugggucgauauaguccuagaacauggcggaugcgucacagucauggcacaagacaaacccaccguagacauagagcuagucaccacgaccgugagcaacauggccgaagucagaucauacugcuacgaagcaucaaucucggacauggcauccgacagccgcugucccacacagggagaagccuaccuagacaaacaauccgacacacaauacgucugcaaacgaacccuaguagaccgcgguuggggaaacggaugcggccucuucggcaaaggaagccuggucacaugcgcaaaauucgccugcagcaagaagaugaccggcaaaagcauccaaccugaaaaccucgaauaccgcaucaugcuuuccguacacggcagucaacacuccggaaugaucgucaacgacacagggcacgaaaccgacgaaaaccgcgccaaagucgaaaucacacccaacagcccccgagccgaagccacccucggcggcuucggcucccucggacuagacugcgagcccaggacgggccucgacuucuccgaccuauacuaccucacaaugaacaacaaacacuggcuaguccacaaagaaugguuccacgacaucccccuccccuggcacgcaggcgccgacacaggcacaccacacuggaacaacaaggaagcacucguagaguucaaagacgcccacgcaaaacgccaaacaguaguaguacugggaucccaagaaggagccgugcacaccgcacuagcaggcgcacucgaagccgaaauggacggagcgaagggccgacuaucguccggacaccuuaaaugcaggcugaagauggacaaacucagacuaaaaggaguauccuacucccuaugcacagccgcauucacauucaccaaaauacccgcagaaacccuacacggaaccgucacagucgaaguccaauacgccggaaccgacggccccugcaaaguccccgcgcaaauggccguagacaugcaaacucucacccccguuggaagacucaucaccgccaacccggucaucacggaaaguaccgaaaacuccaaaaugaugcucgagcuagacccacccuucggagauuccuacauagucaucggcguaggagaaaagaaaauaacacaucacuggcacagauccggcuccaccauaggcaaagccuucgaagccaccguacgcggggcuaaacgcauggccguccucggcgacacagcaugggacuucggauccguaggcggagcccucaacucacugggcaaagggauucaccaaaucuucggcgccgccuucaaaagccuauucggcggaaugagcugguucucccaaauccuaauuggcacccuacuaauguggcucggccucaacacgaaaaacggcagcaucagccuuaugugcuuagcccucggaggcguccucaucuuccucuccacagccgucuccgca

SEQ ID NO: 9998 - RNA, 1809 nt, Artificial Sequence
  ZIKV (isolate Z1106033) ME variant CDS opt
auggggaaacgaagcgcaggcuccaucauguggcucgccucacuagcagucgucauagcaugcgcaggcgcagccguaacccucccuucccacucaacaagaaaacuacaaaccagaucacaaacguggcuagaaucgcgagaauacacgaaacaccucaucagagucgaaaacuggauauuuaggaaccccggcuucgcccuagcagcagccgcaaucgcguggcugcugggcagcucaacaucgcaaaaagugauauaccuaguaaugauccuccuaauagccccggcauacagcauacgcugcaucggaguaucaaaccgagacuuugucgaggguauguccggcggaacauggguagacgugguucucgaacacggcggcugcguaaccguaauggcacaagacaaaccaaccguggacaucgaacucgucacaacaaccguaagcaacauggccgagguacgauccuacugcuacgaagccagcauuucagacauggcaagcgacuccagaugcccaacccagggcgaagccuaccucgacaaacaaagcgacacacaauacguaugcaaacgaacacucguggaccgaggcuggggaaacggcugcggacuguucggaaaaggaagccuagugaccugcgcgaaauucgccugcuccaagaaaaugacaggaaaaucaauccagccugaaaaccucgaguaccgaauaaugcucagcguccauggaagccagcacuccggcaugauaguaaacgacacaggacacgaaacggacgaaaacagagcaaaaguagaaaucaccccaaacucacccagagccgaagcaacacuuggaggcuucggcucacucggacuagacugcgagccacgcaccggacucgacuucagcgaccucuacuaccuaaccaugaacaacaaacacuggcuuguacacaaagaaugguuccacgacauaccccucccuuggcacgcaggagcagacaccggaacaccccacuggaacaacaaagaagcacugguagaguucaaagacgcacacgcaaaacgacaaaccguagucgugcugggcagucaagaaggcgccgugcacaccgcccucgcuggagcccuugaagcagaaauggacggggccaaaggcagacucucauccggccaccucaaaugccgacucaaaauggacaaacuuagacuaaaaggcguaagcuacagccugugcacggcggcauucacauucacgaaaauaccagccgagacccuacacggcacugucaccguagaaguacaguacgcaggcacagacgggcccugcaaaguacccgcacaaauggccguugacaugcaaacccuaaccccagucggccgccucaucaccgccaaccccguaauaacagaaagcacagaaaacagcaaaaugaugcucgaacucgacccaccguucggagacagcuacaucguaaucggcgugggcgaaaagaaaauaacgcaucacuggcaccgaucaggaucaaccaucggcaaagccuucgaagcaaccguucgcggcgcaaaaagaauggccguacuaggcgacacggcaugggauuucgguagcguagggggcgcccuaaacucccuaggcaaaggcauccaccaaaucuucggcgccgcauucaaaucacuauucggcggaaugagcugguucagccaaauccucaucggcacccuccucaugugguuaggacugaaugccaaaaacggaagcaucucacucaugugccuagcccugggaggaguauuaaucuuccuaucuacagcaguaucggcc

SEQ ID NO: 9999 - RNA, 1797 nt, Artificial Sequence
  ZIKV (strain MR 766) ME variant CDS opt
augggcaaaagaucagccggaucaaucauguggcuugcaagccucgcuguaguaaucgccugcgcuggagcagcagucacccuccccucacacuccaccagaaaacuacaaacacgcucccaaacauggcucgaaucacgagaauacaccaaacaccucaucaaggucgaaaacuggaucuuccgaaaccccggauucgcacucguagcaguagccaucgcauggcuacucggauccucaaccagccagaaaguaauauaccuagucaugauccuccugauagcacccgccuacagcauccgaugcaucggcgucagcaaccgagacuucgucgaaggcaugucagggggaaccugggucgacgucguccuagagcacggcggcugcguaacagucauggcacaagacaagcccaccgucgacauagaacuggucacaacuaccguauccaacauggccgagguaagauccuacugcuacgaagccagcauaagcgacauggccagcgacaguaggugcccuacacaaggcgaagccuaccucgauaaacaaucagacacccaauaugucuguaaacgcacucuaguagacagaggauggggcaacggcugcggccuauuuggcaaaggcagccuagucacaugcgcaaaguuuaccugcagcaagaaaaugaccggaaaaucaauccaaccagaaaaccucgaauaccgaaucaugcucucaguacacggaucgcaacacucaggcaugaucggcuaugaaaccgacgaagaccgugccaaaguagaaguaaccccaaacagcccacgagcugaagcaacccuaggaggcuucggaucccucgggcucgacugcgaaccaagaaccggccuagacuucuccgaccuguacuaccucacgaugaacaacaaacacuggcucguacacaaggaaugguuccacgacauaccgcuacccuggcacgcaggcgcagacacaggcacgccacacuggaacaacaaagaagcccuaguggaguucaaagacgcacacgcaaaacgccagaccguggucguccuagggagccaagaaggagccguacacacagcccuggccggcgcccuugaagccgaaauggacggcgcaaaaggccgacucuucagcggacaccucaaaugccgucucaaaauggacaaacuacggcucaaaggcguauccuauucacucugcaccgccgccuucacauucacaaaggucccugcggaaacucuacacggaacagucacagucgaagugcaauacgcaggaaccgacggcccuugcaagauaccaguccagauggccgucgacaugcaaacccucacgccagucggccgacucaucaccgcaaaccccguaaucacagaaucaacggaaaacucaaagaugaugcucgagcucgacccucccuucggagacucauacauagucaucggggucggcgacaagaaaauaacccaccacuggcacagaagcggcuccaccaucggaaaagccuucgaagcgacaguccgaggcgcaaaacgcauggccguacucggagacaccgcgugggacuuuggcucaguaggcggcguguuuaacagccucggaaaaggaauccaccaaauauucggagcagcguucaaaucacuguucggcgggauguccugguucucccaaauccucaucggaacacuucucguauggcuaggccuaaacaccaaaaacggaucaaucucacuaacaugccucgcccucggaggagucaugauauuccugucgacugcggucucggcc

SEQ ID NO: 10000 - RNA, 1809 nt, Artificial Sequence
  ZIKV (strain NatalRGN) ME variant CDS opt
augggaaagcgauccgcaggauccauaauguggcucgccucccuagccgucguaauagcgugcgccggcgcagccguaacccuacccucccacagcacccgcaagcuacaaacacgcucacaaaccuggcuugaaucacgcgaguacacuaaacaccuaauacgcguagaaaacuggaucuuccguaaccccggguucgcacucgccgcagccgccaucgccuggcuucuaggaagcuccacaucacaaaaagucaucuaccuagucaugauccuccucauugccccagccuacaguaucagaugcaucggugucuccaaccgggacuucgucgaagggauguccggaggaacauggguagacgucguccucgaacacggcggcugcguaaccguaauggcgcaggacaaaccgacugucgacauagagcuaguaaccacuaccgucuccaacauggcagaaguacgauccuacugcuacgaagccagcauuagcgacauggcauccgacagccgcugccccacccaaggcgaagccuaccucgacaaacaaucagacacccaauacgucugcaaacgcacacucgucgaccguggcuggggcaacggcugcggacucuucggaaagggcucccuaguuaccugcgcaaaguucgccuguuccaagaaaaugaccggcaaaucgauacaaccagaaaaccucgaauaucgaauaaugcucuccguccacggcagccaacacagcggcaugauaguaaacgacaccggacacgaaacagacgaaaaccgcgcuaaagucgaaauaacacccaacucaccccgggccgaagccacccucggcggcuucggaucacucggccucgacugcgagcccagaaccggccuagacuucucggaccucuacuaucuaacaaugaacaacaaacacuggcucguccacaaagaaugguuccacgacaucccacuccccuggcacgccggagccgacaccggaacaccucacuggaacaacaaagaagcccucgucgaguucaaagacgcccacgccaaacgccagacagugguaguacuaggcagccaagaaggagccguccacacggcccuagcaggagcccuggaagccgaaauggacggagcaaaaggcagacucucuagcggccaccucaagugccgccuaaaaauggacaaacuacgacuaaaaggcguuuccuacagccugugcaccgccgccuucacguucacuaaaauacccgccgaaacccuccacggcaccguaacagucgaaguccaauacgcaggaaccgacggaccgugcaaaguaccugcacaaauggccguagacaugcagacccugaccccaguaggcagacuaaucacagccaaccccguaauaacggaaucaaccgaaaacucaaaaaugaugcuugaacuagacccgcccuucggggacaguuacaucguaaucggcgucggagaaaagaaaauaacccaccacuggcacagauccggaucaaccaucggaaaggccuucgaagcaaccguccggggagccaaacgcauggccguccuaggagacacagccugggacuucggcagugucggcggcgcccucaacagucugggaaaaggcauacaccaaaucuucggcgcagcauucaagagccuauucgggggaaugagcugguucucccaaauacuaauaggaacccuccuaauguggcugggacucaacaccaaaaacggcagcaucucacucaugugccucgcccucggcggaguacugauauuccucucuacagcagucuccgcc

SEQ ID NO: 10001 - RNA, 2305 nt, Artificial Sequence
  ZIKV (strain ZikaSPH2015) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10002 - RNA, 2305 nt, Artificial Sequence
  ZIKV (isolate Z1106033) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10003 - RNA, 2293 nt, Artificial Sequence
  ZIKV (strain MR 766) prME-short variant mRNA Design 1 wild type
gggagaaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10004 - RNA, 2305 nt, Artificial Sequence
  ZIKV (strain NatalRGN) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10005 - RNA, 2284 nt, Artificial Sequence
  ZIKV (strain ZikaSPH2015) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10006 - RNA, 2284 nt, Artificial Sequence
  ZIKV (isolate Z1106033) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10007 - RNA, 2272 nt, Artificial Sequence
  ZIKV (strain MR 766) prME-short variant mRNA Design 1 wild type
gggagaaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10008 - RNA, 2284 nt, Artificial Sequence
  ZIKV (strain NatalRGN) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10009 - RNA, 2302 nt, Artificial Sequence
  ZIKV (strain ZikaSPH2015) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10010 - RNA, 2302 nt, Artificial Sequence
  ZIKV (isolate Z1106033) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10011 - RNA, 2290 nt, Artificial Sequence
  ZIKV (strain MR 766) prME-short variant mRNA Design 1 wild type
gggagaaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10012 - RNA, 2302 nt, Artificial Sequence
  ZIKV (strain NatalRGN) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10013 - RNA, 2305 nt, Artificial Sequence
  ZIKV (strain ZikaSPH2015) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10014 - RNA, 2305 nt, Artificial Sequence
  ZIKV (isolate Z1106033) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10015 - RNA, 2293 nt, Artificial Sequence
  ZIKV (strain MR 766) prME-short variant mRNA Design 1 wild type
gggagaaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10016 - RNA, 2305 nt, Artificial Sequence
  ZIKV (strain NatalRGN) prME-short variant mRNA Design 1 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10017 - RNA, 2284 nt, Artificial Sequence
  ZIKV (strain ZikaSPH2015) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10018 - RNA, 2284 nt, Artificial Sequence
  ZIKV (isolate Z1106033) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10019 - RNA, 2272 nt, Artificial Sequence
  ZIKV (strain MR 766) prME-short variant mRNA Design 1 wild type
gggagaaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10020 - RNA, 2284 nt, Artificial Sequence
  ZIKV (strain NatalRGN) prME-short variant mRNA Design 1 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10021 - RNA, 2302 nt, Artificial Sequence
  ZIKV (strain ZikaSPH2015) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10022 - RNA, 2302 nt, Artificial Sequence
  ZIKV (isolate Z1106033) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10023 - RNA, 2290 nt, Artificial Sequence
  ZIKV (strain MR 766) prME-short variant mRNA Design 1 wild type
gggagaaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10024 - RNA, 2302 nt, Artificial Sequence
  ZIKV (strain NatalRGN) prME-short variant mRNA Design 1 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10025 - RNA, 2005 nt, Artificial Sequence
  ZIKV (strain ZikaSPH2015) ME variant mRNA Design 1 wild type
gggagaaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10026 - RNA, 2005 nt, Artificial Sequence
  ZIKV (isolate Z1106033) ME variant mRNA Design 1 wild type
gggagaaagcuuaccaugacgagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10027 - RNA, 1993 nt, Artificial Sequence
  ZIKV (strain MR 766) ME variant mRNA Design 1 wild type
gggagaaagcuuaccaugaccagcaucggaaucauuggccuccugcugacuacagccauggcagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10028 - RNA, 2005 nt, Artificial Sequence
  ZIKV (strain NatalRGN) ME variant mRNA Design 1 wild type
gggagaaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10029 - RNA, 2032 nt, Artificial Sequence
  ZIKV (strain ZikaSPH2015) ME variant mRNA Design 1 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10030 - RNA, 2032 nt, Artificial Sequence
  ZIKV (isolate Z1106033) ME variant mRNA Design 1 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10031 - RNA, 2020 nt, Artificial Sequence
  ZIKV (strain MR 766) ME variant mRNA Design 1 wild type
gggagaaagcuuaccauggccauaaguggagucccugugcuaggauuuuucaucauagcugugcugaugagcgcucaggaaucaugggcugccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10032 - RNA, 2032 nt, Artificial Sequence
  ZIKV (strain NatalRGN) ME variant mRNA Design 1 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10033 - RNA, 2011 nt, Artificial Sequence
  ZIKV (strain ZikaSPH2015) ME variant mRNA Design 1 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10034 - RNA, 2011 nt, Artificial Sequence
  ZIKV (isolate Z1106033) ME variant mRNA Design 1 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10035 - RNA, 1999 nt, Artificial Sequence
  ZIKV (strain MR 766) ME variant mRNA Design 1 wild type
gggagaaagcuuaccauggacuggaccuggauccuguuccucguggccgccgcgacccgcguccacagcgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10036 - RNA, 2011 nt, Artificial Sequence
  ZIKV (strain NatalRGN) ME variant mRNA Design 1 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10037 - RNA, 2029 nt, Artificial Sequence
  ZIKV (strain ZikaSPH2015) ME variant mRNA Design 1 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10038 - RNA, 2029 nt, Artificial Sequence
  ZIKV (isolate Z1106033) ME variant mRNA Design 1 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10039 - RNA, 2017 nt, Artificial Sequence
  ZIKV (strain MR 766) ME variant mRNA Design 1 wild type
gggagaaagcuuaccauggguaaacggagcgcuggcucaaucauguggcucgcgagcuuggcaguugucauagcuugugcaggagccgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10040 - RNA, 2029 nt, Artificial Sequence
  ZIKV (strain NatalRGN) ME variant mRNA Design 1 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10041 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10042 - RNA, 2305 nt, Artificial Sequence
  ZIKV (isolate Z1106033) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10043 - RNA, 2293 nt, Artificial Sequence
  ZIKV (strain MR 766) prME-short variant mRNA Design 1 opt
gggagaaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10044 - RNA, 2305 nt, Artificial Sequence
  ZIKV (strain NatalRGN) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10045 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10046 - RNA, 2284 nt, Artificial Sequence
  ZIKV (isolate Z1106033) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10047 - RNA, 2272 nt, Artificial Sequence
  ZIKV (strain MR 766) prME-short variant mRNA Design 1 opt
gggagaaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10048 - RNA, 2284 nt, Artificial Sequence
  ZIKV (strain NatalRGN) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10049 - RNA, 2302 nt, Artificial Sequence
  ZIKV (strain ZikaSPH2015) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10050 - RNA, 2302 nt, Artificial Sequence
  ZIKV (isolate Z1106033) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10051 - RNA, 2290 nt, Artificial Sequence
  ZIKV (strain MR 766) prME-short variant mRNA Design 1 opt
gggagaaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10052 - RNA, 2302 nt, Artificial Sequence
  ZIKV (strain NatalRGN) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10053 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10054 - RNA, 2305 nt, Artificial Sequence
  ZIKV (isolate Z1106033) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10055 - RNA, 2293 nt, Artificial Sequence
  ZIKV (strain MR 766) prME-short variant mRNA Design 1 opt
gggagaaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10056 - RNA, 2305 nt, Artificial Sequence
  ZIKV (strain NatalRGN) prME-short variant mRNA Design 1 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10057 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10058 - RNA, 2284 nt, Artificial Sequence
  ZIKV (isolate Z1106033) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10059 - RNA, 2272 nt, Artificial Sequence
  ZIKV (strain MR 766) prME-short variant mRNA Design 1 opt
gggagaaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10060 - RNA, 2284 nt, Artificial Sequence
  ZIKV (strain NatalRGN) prME-short variant mRNA Design 1 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10061 - RNA, 2302 nt, Artificial Sequence
  ZIKV (strain ZikaSPH2015) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10062 - RNA, 2302 nt, Artificial Sequence
  ZIKV (isolate Z1106033) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10063 - RNA, 2290 nt, Artificial Sequence
  ZIKV (strain MR 766) prME-short variant mRNA Design 1 opt
gggagaaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10064 - RNA, 2302 nt, Artificial Sequence
  ZIKV (strain NatalRGN) prME-short variant mRNA Design 1 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10065 - RNA, 2005 nt, Artificial Sequence
  ZIKV (strain ZikaSPH2015) ME variant mRNA Design 1 opt
gggagaaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10066 - RNA, 2005 nt, Artificial Sequence
  ZIKV (isolate Z1106033) ME variant mRNA Design 1 opt
gggagaaagcuuaccaugaccagcguggggaucgugggccuccugcugacgaccgccauggcggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10067 - RNA, 1993 nt, Artificial Sequence
  ZIKV (strain MR 766) ME variant mRNA Design 1 opt
gggagaaagcuuaccaugaccagcaucgggaucaucggccugcugcucacgaccgccauggcggccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10068 - RNA, 2005 nt, Artificial Sequence
  ZIKV (strain NatalRGN) ME variant mRNA Design 1 opt
gggagaaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10069 - RNA, 2032 nt, Artificial Sequence
  ZIKV (strain ZikaSPH2015) ME variant mRNA Design 1 opt
gggagaaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10070 - RNA, 2032 nt, Artificial Sequence
  ZIKV (isolate Z1106033) ME variant mRNA Design 1 opt
gggagaaagcuuaccauggccaucagcggcgugcccguccugggguucuucaucaucgccgugcucauguccgcgcaggagagcugggccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10071 - RNA, 2020 nt, Artificial Sequence
  ZIKV (strain MR 766) ME variant mRNA Design 1 opt
gggagaaagcuuaccauggccaucagcggcgugcccguccugggguucuucaucaucgccgugcucauguccgcgcaggagagcugggccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10072 - RNA, 2032 nt, Artificial Sequence
  ZIKV (strain NatalRGN) ME variant mRNA Design 1 opt
gggagaaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10073 - RNA, 2011 nt, Artificial Sequence
  ZIKV (strain ZikaSPH2015) ME variant mRNA Design 1 opt
gggagaaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10074 - RNA, 2011 nt, Artificial Sequence
  ZIKV (isolate Z1106033) ME variant mRNA Design 1 opt
gggagaaagcuuaccauggacuggaccuggauccuguuccucguggccgccgcgacccgcguccacagcgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10075 - RNA, 1999 nt, Artificial Sequence
  ZIKV (strain MR 766) ME variant mRNA Design 1 opt
gggagaaagcuuaccauggacuggaccuggauccuguuccucguggccgccgcgacccgcguccacagcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10076 - RNA, 2011 nt, Artificial Sequence
  ZIKV (strain NatalRGN) ME variant mRNA Design 1 opt
gggagaaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10077 - RNA, 2029 nt, Artificial Sequence
  ZIKV (strain ZikaSPH2015) ME variant mRNA Design 1 opt
gggagaaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10078 - RNA, 2029 nt, Artificial Sequence
  ZIKV (isolate Z1106033) ME variant mRNA Design 1 opt
gggagaaagcuuaccaugggcaagcgcagcgccggguccaucauguggcuggccagccucgcgguggucaucgccugcgccggcgccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10079 - RNA, 2017 nt, Artificial Sequence
  ZIKV (strain MR 766) ME variant mRNA Design 1 opt
gggagaaagcuuaccaugggcaagcgcagcgccggguccaucauguggcuggccagccucgcgguggucaucgccugcgccggcgccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10080 - RNA, 2029 nt, Artificial Sequence
  ZIKV (strain NatalRGN) ME variant mRNA Design 1 opt
gggagaaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10081 - RNA, 2305 nt, Artificial Sequence
  ZIKV (strain ZikaSPH2015) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10082 - RNA, 2305 nt, Artificial Sequence
  ZIKV (isolate Z1106033) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10083 - RNA, 2293 nt, Artificial Sequence
  ZIKV (strain MR 766) prME-short variant mRNA Design 1 opt
gggagaaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10084 - RNA, 2305 nt, Artificial Sequence
  ZIKV (strain NatalRGN) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10085 - RNA, 2284 nt, Artificial Sequence
  ZIKV (strain ZikaSPH2015) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10086 - RNA, 2284 nt, Artificial Sequence
  ZIKV (isolate Z1106033) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10087 - RNA, 2272 nt, Artificial Sequence
  ZIKV (strain MR 766) prME-short variant mRNA Design 1 opt
gggagaaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10088 - RNA, 2284 nt, Artificial Sequence
  ZIKV (strain NatalRGN) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10089 - RNA, 2302 nt, Artificial Sequence
  ZIKV (strain ZikaSPH2015) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10090 - RNA, 2302 nt, Artificial Sequence
  ZIKV (isolate Z1106033) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10091 - RNA, 2290 nt, Artificial Sequence
  ZIKV (strain MR 766) prME-short variant mRNA Design 1 opt
gggagaaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10092 - RNA, 2302 nt, Artificial Sequence
  ZIKV (strain NatalRGN) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10093 - RNA, 2305 nt, Artificial Sequence
  ZIKV (strain ZikaSPH2015) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10094 - RNA, 2305 nt, Artificial Sequence
  ZIKV (isolate Z1106033) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10095 - RNA, 2293 nt, Artificial Sequence
  ZIKV (strain MR 766) prME-short variant mRNA Design 1 opt
gggagaaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10096 - RNA, 2305 nt, Artificial Sequence
  ZIKV (strain NatalRGN) prME-short variant mRNA Design 1 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10097 - RNA, 2284 nt, Artificial Sequence
  ZIKV (strain ZikaSPH2015) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10098 - RNA, 2284 nt, Artificial Sequence
  ZIKV (isolate Z1106033) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10099 - RNA, 2272 nt, Artificial Sequence
  ZIKV (strain MR 766) prME-short variant mRNA Design 1 opt
gggagaaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10100 - RNA, 2284 nt, Artificial Sequence
  ZIKV (strain NatalRGN) prME-short variant mRNA Design 1 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10101 - RNA, 2302 nt, Artificial Sequence
  ZIKV (strain ZikaSPH2015) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10102 - RNA, 2302 nt, Artificial Sequence
  ZIKV (isolate Z1106033) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10103 - RNA, 2290 nt, Artificial Sequence
  ZIKV (strain MR 766) prME-short variant mRNA Design 1 opt
gggagaaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10104 - RNA, 2302 nt, Artificial Sequence
  ZIKV (strain NatalRGN) prME-short variant mRNA Design 1 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10105 - RNA, 2005 nt, Artificial Sequence
  ZIKV (strain ZikaSPH2015) ME variant mRNA Design 1 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10106 - RNA, 2005 nt, Artificial Sequence
  ZIKV (isolate Z1106033) ME variant mRNA Design 1 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10107 - RNA, 1993 nt, Artificial Sequence
  ZIKV (strain MR 766) ME variant mRNA Design 1 opt
gggagaaagcuuaccaugaccuccaucggcaucaucggccuccuccucaccaccgccauggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10108 - RNA, 2005 nt, Artificial Sequence
  ZIKV (strain NatalRGN) ME variant mRNA Design 1 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10109 - RNA, 2032 nt, Artificial Sequence
  ZIKV (strain ZikaSPH2015) ME variant mRNA Design 1 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10110 - RNA, 2032 nt, Artificial Sequence
  ZIKV (isolate Z1106033) ME variant mRNA Design 1 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10111 - RNA, 2020 nt, Artificial Sequence
  ZIKV (strain MR 766) ME variant mRNA Design 1 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10112 - RNA, 2032 nt, Artificial Sequence
  ZIKV (strain NatalRGN) ME variant mRNA Design 1 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10113 - RNA, 2011 nt, Artificial Sequence
  ZIKV (strain ZikaSPH2015) ME variant mRNA Design 1 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10114 - RNA, 2011 nt, Artificial Sequence
  ZIKV (isolate Z1106033) ME variant mRNA Design 1 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10115 - RNA, 1999 nt, Artificial Sequence
  ZIKV (strain MR 766) ME variant mRNA Design 1 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10116 - RNA, 2011 nt, Artificial Sequence
  ZIKV (strain NatalRGN) ME variant mRNA Design 1 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10117 - RNA, 2029 nt, Artificial Sequence
  ZIKV (strain ZikaSPH2015) ME variant mRNA Design 1 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10118 - RNA, 2029 nt, Artificial Sequence
  ZIKV (isolate Z1106033) ME variant mRNA Design 1 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10119 - RNA, 2017 nt, Artificial Sequence
  ZIKV (strain MR 766) ME variant mRNA Design 1 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10120 - RNA, 2029 nt, Artificial Sequence
  ZIKV (strain NatalRGN) ME variant mRNA Design 1 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10121 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgaucggaaaggccuucgaagcuaccgugcgcggugccaaaagaauggcaguacuaggcgauacugcuugggacuuuggguccgugggaggcgcccucaauucucuggguaaggggauucaccaaaucuucggcgcggccuuuaaaucgcuuuucggaggcaugagcugguuuucccagauuuugauagggacacugcucauguggcugggacuuaacaccaagaauggcucaaucagucugauguguuuggcucucggugggguucugauuuucuuaucuacagcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10122 - RNA, 2305 nt, Artificial Sequence
  ZIKV (isolate Z1106033) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcaccaucggaaaggccuucgaagcuacuguacgcggugccaaaagaauggcagugcuaggcgauacagcuugggacuuuggguccguuggaggcgcccucaauucucuggguaaggggauccaccaaauuuucggcgcggccuuuaaaucgcuuuucggaggcaugagcugguuuucccagaucuugauugggacccugcucauguggcugggacuuaacgcuaagaauggcucaauaagucugauguguuuggcacucggugggguccugaucuucuuaucuacagccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10123 - RNA, 2293 nt, Artificial Sequence
  ZIKV (strain MR 766) prME-short variant mRNA Design 1 opt
gggagaaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgauuggaaaggcuuuugaggccaccgugcggggugcaaaacgcauggccgugcuaggcgacacugcuugggauuucggguccgucggaggcguuuuuaauucucucgguaaggggauccaccaaaucuucggcgccgcauuuaaaucgcuguucggaggcaugagcugguuuucccagauucuuaucgggacauugcugguguggcucggacugaacaccaagaacggcucaauuagucuuacaugucuggcuuuggguggggugaugauauuccucucuacugccguaagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10124 - RNA, 2305 nt, Artificial Sequence
  ZIKV (strain NatalRGN) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgaucggaaaggccuucgaagcuaccguacgcggugccaaaagaauggcagugcuaggcgauacugcuugggacuuuggguccguuggaggcgcccucaauucucuggguaaggggauccaccaaauuuucggcgcggccuuuaaaucgcuuuucggaggcaugagcugguuuucccagaucuugauugggacacugcucauguggcugggacuuaacaccaagaauggcucaauaagucugauguguuuggcucucggugggguccugaucuucuuaucuacagcagugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10125 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacuauuggcaaggcauucgaggccacagucagaggggcuaaaaggauggccgugcuaggagacaccgcaugggauuucgguaguguaggcggggcucucaauagccugggaaagggcauccaucagaucuuuggugccgcguucaaaucccuuuuugggggcaugucuugguucucgcaaauuuugaucggaacacugcucauguggcugggccuuaacacuaagaaugggagcauuucccugauguguuuggcccucggaggcgugcugauauuuuuaucaaccgcuguuagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10126 - RNA, 2284 nt, Artificial Sequence
  ZIKV (isolate Z1106033) prME-short variant mRNA Design 1 opt
gggagaaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacaauaggcaaggcauucgaggccaccgugagaggggcuaaaaggauggccguacuaggagacacagcaugggauuucgguagugugggcggggcucucaauagccugggaaagggcauucaucagaucuuuggugccgcguucaaaucccuuuuugggggcaugucuugguucucgcaaaucuugauuggaacucugcucauguggcugggccuuaacgccaagaaugggagcaucucccugauguguuuggcucucggaggcguucugaucuuuuuaucaaccgcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10127 - RNA, 2272 nt, Artificial Sequence
  ZIKV (strain MR 766) prME-short variant mRNA Design 1 opt
gggagaaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacuaucggcaaggcguucgaagcuacaguccgcggggccaaaagaauggcagugcuaggagauaccgccugggacuuugguagugugggcggggucuucaauagccucggaaagggcauacaucagauuuuuggugcugccuucaaaucccuguuugggggcaugucuugguucucgcaaauccuuaucggaacauugcugguuuggcucggccugaacacuaagaacgggagcauuucccuuaccugucuggcauugggaggcgugaugaucuuucucucaacggcugugagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10128 - RNA, 2284 nt, Artificial Sequence
  ZIKV (strain NatalRGN) prME-short variant mRNA Design 1 opt
gggagaaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacuauaggcaaggcauucgaggccacagugagaggggcuaaaaggauggccguacuaggagacaccgcaugggauuucgguagugugggcggggcucucaauagccugggaaagggcauucaucagaucuuuggugccgcguucaaaucccuuuuugggggcaugucuugguucucgcaaaucuugauuggaacacugcucauguggcugggccuuaacacuaagaaugggagcaucucccugauguguuuggcccucggaggcguucugaucuuuuuaucaaccgcugucagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10129 - RNA, 2302 nt, Artificial Sequence
  ZIKV (strain ZikaSPH2015) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgaucgguaaagccuuugaggcaaccgucagaggcgcuaagaggauggccgugcuaggggauacugcgugggacuucggauccguaggcggugcccucaauucucuggggaaaggcauccaccagauuuucggagcugcauuuaagucgcuuuucggcgggaugagcugguuuucccaaaucuugauuggaacacugcucauguggcugggccuuaacaccaaaaaugguucaauaagucugaugugcuuggcccucgggggagugcugaucuucuuaucuacagcuguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10130 - RNA, 2302 nt, Artificial Sequence
  ZIKV (isolate Z1106033) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcaccauugguaaagccuuugaggcaacugugagaggcgcuaagaggauggccguacuaggggauacagcgugggacuucggauccgugggcggugcccucaauucucuggggaaaggcauccaccagaucuucggagcugcauuuaagucgcuuuucggcgggaugagcugguuuucccaaauuuugaucggaacccugcucauguggcugggccuuaacgccaaaaaugguucaauuagucugaugugcuuggcucucgggggaguucugauauucuuaucuacagccgucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10131 - RNA, 2290 nt, Artificial Sequence
  ZIKV (strain MR 766) prME-short variant mRNA Design 1 opt
gggagaaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcugggaggguucggcucccuuggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgauagguaaagcauucgaagccaccguccgcggcgcuaagagaauggccgugcuaggggacacugcaugggauuucggauccgugggcggugucuuuaauucucucgggaaaggcauucaccagaucuucggagcugccuuuaagucgcuguucggcgggaugagcugguuuucccaaauccuuauuggaacauugcugguuuggcucggccugaacaccaagaacgguucaaucagucuuacaugccuggcgcucgggggagugaugauuuucuugucuacugccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10132 - RNA, 2302 nt, Artificial Sequence
  ZIKV (strain NatalRGN) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgauugguaaagccuuugaggcaaccgugagaggcgcuaagaggauggccguacuaggggauacugcgugggacuucggauccgugggcggugcccucaauucucuggggaaaggcauccaccagaucuucggagcugcauuuaagucgcuuuucggcgggaugagcugguuuucccaaauuuugaucggaacacugcucauguggcugggccuuaacaccaaaaaugguucaauuagucugaugugcuuggcccucgggggaguucugauauucuuaucuacagcugucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10133 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgcuaggaaaggccuucuccaccacucucaaaggugcucaacgccuggccgcacuuggcgauacagcuugggacuuugggucuaucggaggcguguucaauucgauugguagagccguacaccagguguuugggggcgcguucaggaccuuguuuggaggcaugagcuggaucacacaggggcugaugggagcccuccugcuuuggaugggcguuaacgcucgugaucgguccauugcacuggccuucuuggcuacuggugggguccucguguuucuggccaccaaugugcaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10134 - RNA, 2305 nt, Artificial Sequence
  ZIKV (isolate Z1106033) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcacccuaggaaaggccuucuccacuacacucaaaggugcucaacgccuggccgcacuuggcgauaccgcuugggacuuugggucuaucggaggcguauucaauucgaucgguagagccgugcaccagguuuuugggggcgcguucaggacauuguuuggaggcaugagcuggauuacucaggggcugaugggagcccuccugcuuuggaugggcgucaacgcucgugaucgguccaucgcacuggccuucuuggcuaccgguggggugcucguguuucuggccacgaauguccaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10135 - RNA, 2293 nt, Artificial Sequence
  ZIKV (strain MR 766) prME-short variant mRNA Design 1 opt
gggagaaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgcuaggaaaggcuuuuuccaccacucucaaaggugcccaacggcuggcagcccuuggcgacacagcuugggauuucgggucuauuggaggcguguuuaauucgaucggucgcgccgugcaccaggucuucgggggcgcauuuagaaccuuguucggaggcaugagcuggaucacacaggggcugaugggagcucuccugcuuuggaugggcguuaacgccagggaccguuccauugcgcuggccuuuuuggcuacugguggggugcucguguuccuggcaaccaacguacaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10136 - RNA, 2305 nt, Artificial Sequence
  ZIKV (strain NatalRGN) prME-short variant mRNA Design 1 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgcuaggaaaggccuucuccaccacucucaaaggugcucaacgccuggccgcacuuggcgauacagcuugggacuuugggucuaucggaggcguauucaauucgaucgguagagccgugcaccagguuuuugggggcgcguucaggaccuuguuuggaggcaugagcuggauuacacaggggcugaugggagcccuccugcuuuggaugggcgucaacgcucgugaucgguccaucgcacuggccuucuuggcuacugguggggugcucguguuucuggccaccaauguccaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10137 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacucuaggcaaggcauucaguacaacccucaaaggggcccagagacuggcugcccuuggagacacagcaugggauuucgguagcauuggcggggucuuuaauuccaucggaagggcugugcaucaaguauucggcggugccuuucguacuuuguucgggggcaugucuuggaucacccagggacugaugggcgcgcuccugcuuuggaugggggugaacgcccgggaccgaucgauugcucuggcauuuuuggccacgggaggcguucucgucuuccuggcuaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10138 - RNA, 2284 nt, Artificial Sequence
  ZIKV (isolate Z1106033) prME-short variant mRNA Design 1 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacacuaggcaaggcauucaguaccacacucaaaggggcccagagacuggcugcccuuggagacacugcaugggauuucgguagcauaggcgggguguuuaauuccauuggaagggcuguacaucaaguguucggcggugccuuucguaccuuguucgggggcaugucuuggaucacgcagggacugaugggcgcgcuccugcuuuggauggggguuaacgcccgggaccgaucgaucgcucuggcauuuuuggccaccggaggcguccucguguuccuggcuacaaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10139 - RNA, 2272 nt, Artificial Sequence
  ZIKV (strain MR 766) prME-short variant mRNA Design 1 opt
gggagaaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacucuaggcaaggcguucaguacaacccucaaaggggcucagcgccuggccgcacuuggagauacagccugggacuuugguagcaucggcggggucuucaauuccauaggcagagcugugcaucaaguguuuggaggugccuucaggacuuuguuugggggcaugucuuggauuacccagggacugaugggcgcacuccugcuuuggaugggggucaacgcucgugaucggucgaucgcccuggcguucuuggccacgggaggcguucucguguuucuggcuaccaacgugcacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10140 - RNA, 2284 nt, Artificial Sequence
  ZIKV (strain NatalRGN) prME-short variant mRNA Design 1 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacucuaggcaaggcauucaguacaacccucaaaggggcccagagacuggcugcccuuggagacacagcaugggauuucgguagcauaggcgggguguuuaauuccauuggaagggcuguacaucaaguguucggcggugccuuucguacuuuguucgggggcaugucuuggaucacccagggacugaugggcgcgcuccugcuuuggauggggguuaacgcccgggaccgaucgaucgcucuggcauuuuuggccacgggaggcguccucguguuccuggcuaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10141 - RNA, 2302 nt, Artificial Sequence
  ZIKV (strain ZikaSPH2015) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgcuagguaaagccuuuuccaccacucucaagggcgcacagagacuggcugcccuuggggauacagcgugggacuucggaucuaucggcggugucuucaauucgaucgggagggccgugcaccaaguauuuggcggagcuuuccguaccuuguuuggcgggaugagcuggauuacacagggacugaugggcgcacuccugcuuuggaugggugugaacgcccgggaucgauccaucgcucuggccuucuuggcaacugggggaguucucgucuuucuggcgaccaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10142 - RNA, 2302 nt, Artificial Sequence
  ZIKV (isolate Z1106033) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcacccuagguaaagccuuuuccacuacacucaagggcgcacagagacuggcugcccuuggggauaccgcgugggacuucggaucuauuggcgguguguucaauucgaucgggagggccguacaccaaguguuuggcggagcuuuccguacauuguuuggcgggaugagcuggaucacucagggacugaugggcgcacuccugcuuuggauggguguuaacgcccgggaucgauccauugcucuggccuucuuggcaaccgggggaguccucguguuucuggcgacgaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10143 - RNA, 2290 nt, Artificial Sequence
  ZIKV (strain MR 766) prME-short variant mRNA Design 1 opt
gggagaaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcuugggggauucggcucccugggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgcuagguaaagcauucuccaccacucucaagggcgcccagcgccuggcugcccuuggggacacagcaugggauuucggaucuauaggcggugucuuuaauucgauugggagagcugugcaccaaguguucggcggagccuuuaggaccuuguucggcgggaugagcuggaucacacagggacugaugggcgcgcuccugcuuuggaugggugucaacgcccgugaccgguccaucgcucuggcauuuuuggccacugggggaguucucguguuccuggcuaccaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10144 - RNA, 2302 nt, Artificial Sequence
  ZIKV (strain NatalRGN) prME-short variant mRNA Design 1 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgcuagguaaagccuuuuccaccacucucaagggcgcacagagacuggcugcccuuggggauacagcgugggacuucggaucuauuggcgguguguucaauucgaucgggagggccguacaccaaguguuuggcggagcuuuccguaccuuguuuggcgggaugagcuggaucacacagggacugaugggcgcacuccugcuuuggauggguguuaacgcccgggaucgauccauugcucuggccuucuuggcaacugggggaguccucguguuucuggcgaccaaugugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10145 - RNA, 2005 nt, Artificial Sequence
  ZIKV (strain ZikaSPH2015) ME variant mRNA Design 1 opt
gggagaaagcuuaccaugaccagcgugggcauugucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugauaucgugcucgagcacggugggugugucacugugauggcccaggacaaaccgacaguagauauugaacugguuaccacgacugugaguaauauggcugaggucagguccuauugcuacgaggccucuaucagcgacauggcguccgauucacggugucccacccagggagaagcauaucuggacaagcaaagugauacacaguacgugugcaaacgcacucucguggacagaggcuggggcaacggguguggauuauuugguaagggcagccuggucacaugcgccaaguucgcuuguucuaaaaagaugacagggaaauccauucagccugagaaucuugaauauaggaucauguugucaguucauggaagccagcacaguggcaugauagugaacgauaccggucaugagacggacgagaaucgggccaagguagaaauuacuccaaacucuccccgcgcagaggcuacacuagggggauuuggcucccugggccucgauugcgaaccucgaaccgggcuggacuucagcgaucuuuacuaccugacuaugaauaacaaacacugguuggugcacaaggagugguuucaugacaucccacuccccuggcacgccggagcggacacagguaccccucauuggaauaacaaggaagcccuggucgaguucaaagaugcacacgcuaagagacaaacggugguuguguuaggcucgcaggagggggccguccacaccgcucuggccggagcacucgaagccgagauggacggcgcuaaagguaggcuuucuuccgggcaucugaagugucgguugaaaauggauaagcuacgucugaaaggcgugucauauagucucugcacagcggcauuuacuuucaccaagauuccagccgaaacacugcacggaacuguaaccguugaggugcaguacgcuggcacagacgggccguguaagguccccgcccagauggcaguggauaugcaaacccuuacuccugucggacgccugaucacggccaauccagugaucacagaaagcaccgagaacuccaaaaugauguuggagcucgaucccccuuuuggugacucuuauauuguuauaggcgugggggaaaagaaaaucacucaucacuggcauagaagcggaucaaccauuggcaaggcuuucgaggccacaguaaggggugcaaaacggauggcgguccugggggacaccgcuugggauuuuggcagugugggaggcgccuuaaauucccuggggaagggaauccaccagauauucggugcagccuucaagagccuauuuggcgggaugucuugguucucacagauucucaucggaacucugcuuaugugguugggccugaacaccaaaaacgguaguaucagccucaugugccuggcucuugggggcguucugaucuuuuuguccacggccgugucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10146 - RNA, 2005 nt, Artificial Sequence
  ZIKV (isolate Z1106033) ME variant mRNA Design 1 opt
gggagaaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacgcuaaaaacgguaguaucagccucaugugccuggcccuugggggcgugcugaucuuuuuguccacagcagucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10147 - RNA, 1993 nt, Artificial Sequence
  ZIKV (strain MR 766) ME variant mRNA Design 1 opt
gggagaaagcuuaccaugaccagcaucggcauuauagggcugcuccuuacaacugccauggcugcagugacgcugcccucccacucuaccagaaaguugcagacaaggucacaaacuugguuagagagucgggaauacaccaaacaucugaucaaggucgagaacuggauuuuccgcaauccuggauuugcccuaguugcgguggcuaucgccuggcuccuggguagcuccacaucucagaaaguaauuuaucuugugaugauccuguugauagcaccagccuacucgauccgaugcauuggcgucucaaaccgugacuucguggaagggaugagcggaggcaccuggguugaugugguccucgagcacggugggugugugacuguaauggcucaggacaagccgacaguugauaucgaacuggugaccacgacugucaguaauauggcagaggugagauccuauugcuacgaggccucuauuagcgacauggcuuccgauucaaggugucccacccagggagaagccuaucuggacaaacaaagugauacacaguacgugugcaagcggacucucgucgaccgcggcuggggcaacggguguggauuauuugguaagggcagccugguuaccugcgcgaaauucacauguucuaagaaaaugaccgggaaguccauccagccugagaaucuugaauauagaauaauguugucagugcauggaagccagcacaguggcaugauugguuacgagacggaugaggacagggcaaaaguagaagugacuccaaacucuccccgggccgaggcuacacuugggggauuuggcucccuaggccucgauugcgaaccucgcaccgggcuggacuucagcgaucuuuacuaucugacuaugaauaacaagcauugguugguccacaaggagugguuucacgacaucccacuccccuggcaugccggagcagacacagguaccccucacuggaauaacaaagaagcucugguggaguucaaggaugcccaugcgaaacgacaaacgguuguggucuuaggcucgcaggagggggccgugcacaccgcacuggcuggagcccucgaagcugagauggacggcgccaaggguagacuguuuucugggcaccugaaauguagguugaagauggauaaacuacggcugaagggcguauccuacucacucugcacagcagccuucacuuuuaccaagguuccagcugaaacacugcauggaacugugaccgucgaggugcaguaugcgggcacagacgggccguguaaaauucccguccagauggcaguggauaugcaaacccuuacuccuguuggacgucugaucacggccaauccagugaucacagaaaguaccgagaacagcaagaugauguuggagcucgaucccccuuucggugacuccuacauuguaauaggcgucggggacaaaaagaucacucaccauuggcaccgcucuggaagcaccauuggcaaggcuuuugaagccacagugagaggugcaaaaaggauggccguucugggggauaccgcuugggacuucggcucagugggaggcgucuucaauaguuuagggaagggaauccaucagauauuuggugccgcauucaaaucccuguuuggcgggaugagcugguucucucagauucuaaucggaacucuccugguguggcuuggcuugaacacaaagaaugguucaaucagucugacgugccucgcgcuugggggcguaaugauuuuucugagcaccgcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10148 - RNA, 2005 nt, Artificial Sequence
  ZIKV (strain NatalRGN) ME variant mRNA Design 1 opt
gggagaaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacacgaaaaacgguaguaucagccucaugugccuggcucuugggggcgugcugaucuuuuuguccacagccgucucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10149 - RNA, 2032 nt, Artificial Sequence
  ZIKV (strain ZikaSPH2015) ME variant mRNA Design 1 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggauaucgucuuggaacacggugggugugugaccguaauggcccaggacaaacccacaguugauauugagcucgugaccacuacagucucuaauauggcggaggugaggagcuauugcuacgaagcauccaucucagacauggccagugauagccgguguccuacccaaggagaggcuuaucuggacaagcagucugauacgcaguacgugugcaaacgcacucuggucgacagaggcuggggcaacggguguggacucuuugguaagggcuccuuaguuaccugcgccaaguucgcauguagcaaaaagaugacagggaaaucaauacagccagaaaaucuggaguauaggauuaugcuuagugugcauggaucucaacacuccggcaugaucguaaacgauacuggucaugagaccgacgaaaaucgggcuaagguggagauuacacccaacagcccucgcgccgaagcgaccuugggaggauuuggcucgcugggccuagauugcgagccacgaacggggcucgacuucucugaucuguacuaccuuacuaugaauaacaaacacuggcugguccacaaggaaugguuucaugacauccccuugccuuggcacgccggagcagacacagguaccccacauuggaauaacaaggaggcucucguggaguucaaagaugcccacgcuaagagacagacuguugugguccugggcucccaggaaggggccgugcacacagcauuagccggagcucuggaggcggaaauggacggcgcaaaagguaggcucucaagugggcaucuuaagugucggcugaaaauggauaaguugcgucuaaaaggcguaagcuauucccugugcaccgccgcuuuuacguucaccaagaucccggccgagacacuccacggaacuguuaccguggaaguccaguacgcaggcacagacgggcccuguaaggugccugcccaaauggcugucgauaugcagacucugaccccagugggacgccuuauuacagccaaucccguuauaaccgagucuacugagaacagcaaaaugaugcuggaauuggacccuccauuuggugauucauauaucgugauuggcguaggggagaagaaaaucacgcaucacuggcauagaaguggauccacaauaggcaaggcauucgaagcgaccgucaggggugcuaaacggauggccgugcucggggacacugcaugggauuucggcagcguuggaggcgccuuaaauucucuggggaaggggauucaccagaucuuuggugcugccuucaagucacuguuuggcgggaugaguugguucagccaaauccuaauuggaacccuccugauguggcuuggcuugaacaccaaaaacgguuccaucucucugaugugccucgcacuugggggcgugcugauuuuucugucgacagcugucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10150 - RNA, 2032 nt, Artificial Sequence
  ZIKV (isolate Z1106033) ME variant mRNA Design 1 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacgcuaaaaacgguuccauuucucugaugugccucgcacuugggggcguccugaucuuucugucgacagccgugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10151 - RNA, 2020 nt, Artificial Sequence
  ZIKV (strain MR 766) ME variant mRNA Design 1 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaaucaagguagaaaacuggauuuuccgcaauccaggauuugcucugguggccgucgcaaucgccuggcuacucgguucuucgacaucacagaaagugauuuaucugguuaugauccuucugauagcuccggcauacagcauccgaugcauuggcgugaguaaccgugacuucgucgaggggauguccggaggcacuuggguggauguaguuuuggaacacggugggugugugaccgucauggcccaggacaagcccacaguggauaucgagcucgugaccacuacagucucuaauauggcugagguuagaagcuauugcuacgaagccuccauuucagacauggcgagugauucuagguguccuacccaaggagaggcauaucuggacaaacagagcgauacgcaguacgugugcaagcggacucugguagaccgcggcuggggcaacggguguggacucuuugguaagggcuccuuagugaccugcgccaaauucacauguucaaagaaaaugacuggaaagagcauccagccagaaaaucuggaguauagaauaaugcuuaguguccaugggucucaacacuccggcaugauugguuacgagaccgaugaagacagggcuaaaguggagguuacacccaacagcccucgggccgaagcaaccuugggaggguuuggcucgcugggccuagauugcgagccacgcacggggcucgacuucucugaucuguacuaucuuacuaugaauaacaagcauuggcuggugcacaaggaaugguuucacgacauccccuugccuuggcaugcuggagccgacacagguaccccacacuggaauaacaaagaggcgcucgucgaguucaaggaugcccaugcaaaacgacagacugugguaguucugggcucccaggaaggggcugugcacacagccuuagcuggagcccuggaggcagaaauggacggcgccaaggguagacucuuuucagggcaccuuaaauguaggcugaagauggauaaauugcggcuaaagggcgucaguuacagccugugcaccgcugcguucacguuuaccaaggugccggcagagacacuccauggaacugucaccguggaaguucaguaugccggcacagacgggcccuguaaaauuccugugcaaauggcuguagauaugcagacucugaccccagucggacgucuuaucacagccaaucccgugaucaccgaguccacugagaacucuaagaugaugcuggaauuggacccuccauucggugauagcuacauuguuauaggcgugggggacaaaaagaucacgcaccauuggcaccgcucaggaaguacaauuggcaaagcauucgaggccaccgucagaggugcuaagaggauggccgugcucggggauacugcaugggacuuuggcuccguaggaggcguguucaauagccuggggaagggaauccaucagauauuuggugcggcuuucaaaucuuuauuuggcgggaugucaugguucagucaaauucugaucggaacccuacucguuuggcugggccuuaacacaaagaaugguagcaucuccuugaccugccuggcccucgggggcgucaugauuuuucugucuacugcagugucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10152 - RNA, 2032 nt, Artificial Sequence
  ZIKV (strain NatalRGN) ME variant mRNA Design 1 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacaccaaaaacgguuccauuucucugaugugccucgcacuugggggcguccugaucuuucugucgacagcugugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10153 - RNA, 2011 nt, Artificial Sequence
  ZIKV (strain ZikaSPH2015) ME variant mRNA Design 1 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacaucguguuggagcauggaggcugugucaccgugauggcucaggauaaaccgacuguagacauugaacucguuacaaccacggugaguaauauggccgagguccgguccuauugcuacgaggcgucuaucagcgauauggcauccgacucacgcugucccacucagggugaagccuaucuggauaagcaaagugacacccaguacgugugcaaaagaacacugguggauaggggguggggaaacggcuguggccucuucgggaaggggagcuuagucacuugcgcuaaguuugccuguucuaaaaagaugaccgguaaauccauucagccugagaaucuggaauaucggaucaugcuuucaguucacggcagccagcauagugggaugauagugaacgacacaggacacgagaccgaugagaaucgcgcaaagguagaaauuacgccaaacucuccccgagcugaggccacuuugggcgguuucgggucccugggacuagacugcgaaccuagaacaggccucgauuuuagcgaccuguacuaccuuaccaugaauaacaaacacuggcuggugcauaaggagugguuccacgacaucccauugcccuggcaugcgggcgccgauacugggacaccucacuggaauaacaaggaagcacucgucgaguuuaaagacgcucacgccaagaggcaaaccgugguugugcugggaucgcaggagggugcuguccauacggccuuagcaggcgcccuggaagcugagauggauggggcgaaaggacggcucucuuccggccaccuuaagugucgucugaaaauggacaaguugcgccuaaaaggugugucauauagucugugcaccgcagccuucacauuuacuaagauuccagcugaaacccuccaugggacaguaacuguugaggugcaguacgccggcaccgauggaccguguaagguccccgcacagauggccguggacaugcaaacacugaccccugucggcagacuuaucacugcuaauccagugaucacggaaagcacagagaacuccaaaaugaugcuggaguuggaucccccuuucggggacucuuauauuguuauaggagugggugaaaagaaaaucacccaccauuggcacaggagcggcucaacuauugggaaggccuuugaggcaaccguacggggagcgaaacgaauggcuguccucggcgauacagccugggacuucgguagugugggaggcgcauuaaauucccugggaaagggcauccaccagauauucggggccgcuuuuaagagccuguucggagguaugucuugguuuucacagauucuaaucggcacccuccugauguggcuuggguugaacacuaaaaacggaaguaucagccugaugugccucgcccugggcgguguucuuauuuuccuguccacagcagugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10154 - RNA, 2011 nt, Artificial Sequence
  ZIKV (isolate Z1106033) ME variant mRNA Design 1 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacgccaaaaacggaaguaucagccugaugugccucgcacugggcggugugcuuaucuuccuguccacugcugucucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10155 - RNA, 1999 nt, Artificial Sequence
  ZIKV (strain MR 766) ME variant mRNA Design 1 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauuaagguggagaacuggauauuucgaaauccuggcuucgcgcugguagcuguggccaucgcauggcuacucgggagcuccaccucucagaaagucauuuaucuggugaugauccuucugauugccccagcuuacucgauccguugcauaggaguuucaaacagagauuuuguggaagguaugagcggcgggacaugggucgacgugguauuggagcauggaggcuguguuaccgugauggcacaggauaagccgacugucgacaucgaacucgugacaaccacggugaguaauauggccgaggucagguccuauugcuacgaggcuucuauuagcgauauggccuccgacucacggugucccacucagggugaagcguaucuggauaaacaaagugacacccaguacguuugcaagcgcacacugguggauagaggguggggaaacggcuguggccucuucgggaaggggagcuuaguaacuugcgcaaaauuuaccuguucuaagaaaaugacagguaaguccauccagccugagaaucuggaauauaggauuaugcuuucagugcacggcagccagcauagugggaugaucggauacgagaccgacgaggaucgggccaaagucgaagugacgccaaacucuccccgcgcugaggccacuuugggcgguuucgggucccugggacuagacugcgaaccucgaacaggccucgauuuuagcgaccuguacuaucuuaccaugaauaacaagcacuggcugguucacaaggagugguuccaugacauaccauugcccuggcacgcaggcgcugauacugggacaccucauuggaauaacaaagaagcccucguggaguuuaaggacgcgcacgccaaaagacaaaccgucgugguacugggaucgcaggagggugcaguucacacggcuuuagccggcgcucuggaagccgagauggauggggcaaagggaaggcuuuucucuggccaucucaaaugucggcugaagauggacaaauugcgucuaaaggguguguccuacucacugugcaccgccgcuuuuacauucacuaaggucccagcggaaacccuccacgggacagugacugucgaggugcaguaugcaggcaccgauggaccguguaaaauucccguucagauggccguggacaugcaaacacugaccccuguaggccgccuuaucacugcuaauccagucauuacggaaaguacagagaacagcaagaugaugcuggaguuggaucccccuuuuggggacuccuacaucgugaucggaguuggugauaaaaagauuacccaucacuggcauagaucuggcagcacuauagggaaagccuucgaagcaaccgugaggggagccaagcggauggcuguccucggcgacacagccugggauuucgguucagugggaggcguauuuaauagucugggaaagggcauccaccagauuuucggggcagcguuuaaauccuuauucggagguaugagcugguuuucucagauccugauaggcacccuacucguguggcuggggcuuaacacuaagaauggaucaauuaguuugacaugccuggcucucggcgguguuaugaucuuccugagcacggccgucuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10156 - RNA, 2011 nt, Artificial Sequence
  ZIKV (strain NatalRGN) ME variant mRNA Design 1 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacacuaaaaacggaaguaucagccugaugugccucgcccugggcggugugcuuaucuuccuguccacagcagucucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10157 - RNA, 2029 nt, Artificial Sequence
  ZIKV (strain ZikaSPH2015) ME variant mRNA Design 1 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauauuguguuggagcacgggggaugcgucaccgugauggcacaggacaagccgacaguagauaucgaacucguuaccacuacagugucuaauauggccgagguccggagcuauuguuacgaggcuuccauuucagacauggccagugauagccgcugccccacccagggcgaagcauaucuggacaaacaaucugauacgcaguacguguguaagagaacucugguggacaggggcugggggaacggaugcggucucuuuggcaagggguccuuagucaccugugcuaaauucgccugcucaaagaaaaugacaggaaagagcauccagccugagaaucuggaauaucggauaaugcuuaguguucauggcucucagcacuccgguaugauugugaacgauacugggcaugagaccgacgagaaucgcgcgaaaguagaaaucacaccaaacagcccccgagccgaggcaaccuugggaggcuuuggcucgcuggggcuagauugugaaccuagaacgggacucgacuucucugaucuguacuaccuuacuaugaauaacaagcacuggcuggugcacaaggagugguuucaugacauuccauugcccuggcacgcuggugccgacacaggcaccccucauuggaauaacaaagaagcucucgucgaguucaaggaugcccacgcaaaaaggcaaacugugguugugcuggggucccaggagggagccguccacacagcuuuagcgggcgcacuggaagccgagauggacggugcuaaggggcggcucucaaguggccaucuuaaaugccgucugaagauggauaaauugcgccuaaagggagugagcuauucccuguguaccgccgcauuuacguucaccaagaucccagccgaaacacuccacggcacuguaaccguugaggugcaguacgcugggacagacggaccgugcaaaguccccgcccagauggcaguggauaugcaaacucugaccccugucgguagacuuaucacagcgaauccagugauuaccgaaucuacugagaacagcaagaugaugcuggaguuggaucccccuuuuggcgacucauauauaguuaucggggugggagagaaaaagauuacgcaucacuggcauaggaguggcuccacaaucgguaaggcuuucgaagccaccguacggggcgcaaaacgaauggccguccucggcgacacugcuugggauuuuggaagcgugggcggggccuuaaauucucugggaaaggguauacaccagauuuucggcgcagcuuucaaaucacuguuugggggaaugaguugguucagccagauccuaaucggcacccuccugauguggcuugguuugaacacaaagaacggguccauuucucugaugugccucgcccugggcggaguucuuaucuuucugucgaccgcggugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10158 - RNA, 2029 nt, Artificial Sequence
  ZIKV (isolate Z1106033) ME variant mRNA Design 1 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacgccaagaacggguccaucucucugaugugccucgcgcugggcggagugcuuauuuuucugucgacagccgucagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10159 - RNA, 2017 nt, Artificial Sequence
  ZIKV (strain MR 766) ME variant mRNA Design 1 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauaaaaguggagaacuggaucuuccgaaauccugguuuugcacugguagccguggcuauugcauggcuacucgggucuucgacaucacagaaggucaucuaucuggugaugauucuucugaucgccccagcuuacagcauacguuguaucgggguuaguaacagagacuucguggaaggaauguccggcgguacuugggucgaugugguauuggagcacgggggaugcguuaccgugauggcccaggacaaaccgacagucgauauugaacucgugaccacuacagugucuaauauggcggaggucaggagcuauuguuacgaggcauccaucucagacauggccagugauagccggugccccacccagggcgaggcuuaucuggacaagcaaucugauacgcaguacguuuguaagcgcacucugguggacagaggcugggggaacggaugcggucucuuuggcaaaggguccuuaguaaccugugccaaguucacaugcagcaaaaagaugacuggaaaaucaauucagccugaaaaucuggaauauaggaucaugcuuagugugcauggcucucagcacuccgguaugauaggguacgagaccgaugaggaccgggcaaaggucgaagugacaccaaacagcccccgcgcugaggccaccuugggaggcuuuggcucgcuggggcuagauugugaaccucgaacgggacucgacuucucugaucuguacuaucuuacuaugaauaacaagcauuggcugguucacaaagagugguuucacgacauuccauugcccuggcaugcgggugccgacacaggcaccccucacuggaauaacaaggaagcacucguggaguucaaagaugcucaugccaagagacaaacugucgugguacuggggucccaggagggagcuguucacacagccuuagcaggcgcccuggaagcugagauggacggugcgaaagggaggcucuuuucaggccaccuuaagugccggcugaaaauggauaaguugcgucuaaagggagugaguuacagccuguguaccgcagccuucacguuuaccaaagucccagcugaaacacuccauggcacugugaccgucgaggugcaguaugccgggacagacggaccgugcaagauccccguucagauggcaguggauaugcaaacucugaccccuguaggucgccuuauuacagccaauccagucaucaccgaauccacugagaacucuaaaaugaugcuggaguuggaucccccuuucggcgacagcuacaucgugauugggguuggagacaagaaaauaacgcaccauuggcacagaucaggcaguacaaucgguaaggcuuuugaagccaccgugaggggcgcaaagcggauggcgguccucggcgauacugcuugggacuucggauccgugggcgggguauucaauagccugggaaaagguauucaucagaucuuuggcgccgcauucaagucuuuauuugggggaaugucaugguucagucagauacugauuggcacccuacucguguggcugggucuuaacaccaaaaaugggagcaucuccuugacaugccuggcccucggcggaguuaugaucuuucugucuacugcugucucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10160 - RNA, 2029 nt, Artificial Sequence
  ZIKV (strain NatalRGN) ME variant mRNA Design 1 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacacaaagaacggguccaucucucugaugugccucgcccugggcggagugcuuauuuuucugucgaccgcggucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10161 - RNA, 2305 nt, Artificial Sequence
  ZIKV (strain ZikaSPH2015) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10162 - RNA, 2305 nt, Artificial Sequence
  ZIKV (isolate Z1106033) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10163 - RNA, 2293 nt, Artificial Sequence
  ZIKV (strain MR 766) prME-short variant mRNA Design 1 opt
gggagaaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10164 - RNA, 2305 nt, Artificial Sequence
  ZIKV (strain NatalRGN) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10165 - RNA, 2284 nt, Artificial Sequence
  ZIKV (strain ZikaSPH2015) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10166 - RNA, 2284 nt, Artificial Sequence
  ZIKV (isolate Z1106033) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10167 - RNA, 2272 nt, Artificial Sequence
  ZIKV (strain MR 766) prME-short variant mRNA Design 1 opt
gggagaaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10168 - RNA, 2284 nt, Artificial Sequence
  ZIKV (strain NatalRGN) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10169 - RNA, 2302 nt, Artificial Sequence
  ZIKV (strain ZikaSPH2015) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10170 - RNA, 2302 nt, Artificial Sequence
  ZIKV (isolate Z1106033) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10171 - RNA, 2290 nt, Artificial Sequence
  ZIKV (strain MR 766) prME-short variant mRNA Design 1 opt
gggagaaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10172 - RNA, 2302 nt, Artificial Sequence
  ZIKV (strain NatalRGN) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10173 - RNA, 2305 nt, Artificial Sequence
  ZIKV (strain ZikaSPH2015) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10174 - RNA, 2305 nt, Artificial Sequence
  ZIKV (isolate Z1106033) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10175 - RNA, 2293 nt, Artificial Sequence
  ZIKV (strain MR 766) prME-short variant mRNA Design 1 opt
gggagaaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10176 - RNA, 2305 nt, Artificial Sequence
  ZIKV (strain NatalRGN) prME-short variant mRNA Design 1 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10177 - RNA, 2284 nt, Artificial Sequence
  ZIKV (strain ZikaSPH2015) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10178 - RNA, 2284 nt, Artificial Sequence
  ZIKV (isolate Z1106033) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10179 - RNA, 2272 nt, Artificial Sequence
  ZIKV (strain MR 766) prME-short variant mRNA Design 1 opt
gggagaaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10180 - RNA, 2284 nt, Artificial Sequence
  ZIKV (strain NatalRGN) prME-short variant mRNA Design 1 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10181 - RNA, 2302 nt, Artificial Sequence
  ZIKV (strain ZikaSPH2015) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10182 - RNA, 2302 nt, Artificial Sequence
  ZIKV (isolate Z1106033) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10183 - RNA, 2290 nt, Artificial Sequence
  ZIKV (strain MR 766) prME-short variant mRNA Design 1 opt
gggagaaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10184 - RNA, 2302 nt, Artificial Sequence
  ZIKV (strain NatalRGN) prME-short variant mRNA Design 1 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10185 - RNA, 2005 nt, Artificial Sequence
  ZIKV (strain ZikaSPH2015) ME variant mRNA Design 1 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10186 - RNA, 2005 nt, Artificial Sequence
  ZIKV (isolate Z1106033) ME variant mRNA Design 1 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10187 - RNA, 1993 nt, Artificial Sequence
  ZIKV (strain MR 766) ME variant mRNA Design 1 opt
gggagaaagcuuaccaugaccagcaucggcaucaucggccugcugcugaccaccgccauggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10188 - RNA, 2005 nt, Artificial Sequence
  ZIKV (strain NatalRGN) ME variant mRNA Design 1 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10189 - RNA, 2032 nt, Artificial Sequence
  ZIKV (strain ZikaSPH2015) ME variant mRNA Design 1 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10190 - RNA, 2032 nt, Artificial Sequence
  ZIKV (isolate Z1106033) ME variant mRNA Design 1 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10191 - RNA, 2020 nt, Artificial Sequence
  ZIKV (strain MR 766) ME variant mRNA Design 1 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10192 - RNA, 2032 nt, Artificial Sequence
  ZIKV (strain NatalRGN) ME variant mRNA Design 1 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10193 - RNA, 2011 nt, Artificial Sequence
  ZIKV (strain ZikaSPH2015) ME variant mRNA Design 1 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10194 - RNA, 2011 nt, Artificial Sequence
  ZIKV (isolate Z1106033) ME variant mRNA Design 1 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10195 - RNA, 1999 nt, Artificial Sequence
  ZIKV (strain MR 766) ME variant mRNA Design 1 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10196 - RNA, 2011 nt, Artificial Sequence
  ZIKV (strain NatalRGN) ME variant mRNA Design 1 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10197 - RNA, 2029 nt, Artificial Sequence
  ZIKV (strain ZikaSPH2015) ME variant mRNA Design 1 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10198 - RNA, 2029 nt, Artificial Sequence
  ZIKV (isolate Z1106033) ME variant mRNA Design 1 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10199 - RNA, 2017 nt, Artificial Sequence
  ZIKV (strain MR 766) ME variant mRNA Design 1 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10200 - RNA, 2029 nt, Artificial Sequence
  ZIKV (strain NatalRGN) ME variant mRNA Design 1 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10201 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcugugggcuguucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgauuggcaaggcguucgaagccacagugcggggcgcuaaaagaauggccguccuuggagauaccgcuugggacuuuggcagcguugggggagcccucaauucccucggcaaggggauccaccaaaucuucggcgccgcuuuuaaaucucuguucggaggcaugagcugguuuucccagauucugaucgggacacuucucauguggcugggacugaacaccaagaauggcagcauuucucucaugugucuggcgcuugggggagugcugaucuuccucuccaccgccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10202 - RNA, 2305 nt, Artificial Sequence
  ZIKV (isolate Z1106033) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcugugggcuguucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacaaucggcaaggcguucgaagccaccguccggggcgcuaaaagaauggccgugcuuggagauacagcuugggacuuuggcagcguugggggagcccucaauucccucggcaaggggauucaccaaaucuucggcgccgcuuuuaaaucucuguucggaggcaugagcugguuuucccagauccugauugggacccuucucauguggcugggacugaacgcgaagaauggcagcaucucucucaugugucuggcccuugggggagugcugauuuuccucuccaccgcugucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10203 - RNA, 2293 nt, Artificial Sequence
  ZIKV (strain MR 766) prME-short variant mRNA Design 1 opt
gggagaaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcugcagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcuguggacucuucgggaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgauuggcaaggccuuugaggcuacaguccgcggggccaaacggauggcggugcuuggagacaccgccugggauuucggcagcguugggggaguguuuaauucccugggcaaggggauccaccaaauuuucggcgcugccuuuaaaucucucuucggaggcaugagcugguuuucccagauccugaucgggacacugcuugucuggcucggacugaacaccaagaacggcagcauuucucugaccugucucgcucuugggggagugaugaucuuccuuuccacagccguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10204 - RNA, 2305 nt, Artificial Sequence
  ZIKV (strain NatalRGN) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcugugggcuguucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgaucggcaaggcguucgaagccacaguccggggcgcuaaaagaauggccgugcuuggagauaccgcuugggacuuuggcagcguugggggagcccucaauucccucggcaaggggauucaccaaaucuucggcgccgcuuuuaaaucucuguucggaggcaugagcugguuuucccagauccugauugggacacuucucauguggcugggacugaacaccaagaauggcagcaucucucucaugugucuggcgcuugggggagugcugauuuuccucuccaccgccgucagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10205 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcaccauuggcaaggccuucgaggcgacagugagaggagccaaacgcauggcugugcuuggcgacaccgccugggauuucggguccgucggaggcgcucucaauucucuggggaagggaauccaucagauuuuuggcgccgccuucaaaagccuguuugggggcauguccugguucucucaaauccugaucggaacccuucucauguggcugggccugaacacaaagaaugggagcauuucccucaugugucuggcucuuggaggcgugcugaucuuucucagcacggcgguuucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10206 - RNA, 2284 nt, Artificial Sequence
  ZIKV (isolate Z1106033) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacaaucggcaaggccuucgaggcgaccgugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacacuucucauguggcugggccugaacgcuaagaaugggagcaucucccucaugugucuggcgcuuggaggcguucugauuuuucucagcacggccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10207 - RNA, 2272 nt, Artificial Sequence
  ZIKV (strain MR 766) prME-short variant mRNA Design 1 opt
gggagaaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcaccauuggcaaggcuuucgaagccacagugcggggagcuaaaagaauggccguccuuggcgauaccgcgugggacuuuggguccgugggaggcguuuucaauucucuggggaagggaauccaucagauuuuuggcgccgcuuucaaaagccucuuugggggcauguccugguucucucaaauccugauuggaacccugcuuguguggcucggccugaacacaaagaacgggagcaucucccugacgugucucgcccugggaggcgucaugaucuuucuuagcaccgcugugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10208 - RNA, 2284 nt, Artificial Sequence
  ZIKV (strain NatalRGN) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcaccaucggcaaggccuucgaggcgacagugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacccuucucauguggcugggccugaacacaaagaaugggagcaucucccucaugugucuggcucuuggaggcguucugauuuuucucagcacggcggugucugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10209 - RNA, 2302 nt, Artificial Sequence
  ZIKV (strain ZikaSPH2015) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgaucgggaaggcuuuugaggccacagugagaggagcuaagcgcauggccgugcuuggcgauaccgccugggacuucgggagcgucggaggcgcucucaauucccuggggaaaggcauucaccagaucuucggagcggccuuuaagucucuguucggcgggaugagcugguuuucccaaauccugauuggaacacuucucauguggcugggccugaacaccaaaaaugggagcaucucucucaugugccuggcucuuggaggcgugcugauuuuccucuccaccgccguuagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10210 - RNA, 2302 nt, Artificial Sequence
  ZIKV (isolate Z1106033) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacaauugggaaggcuuuugaggccaccgugagaggagcuaagcgcauggccguccuuggcgauacagccugggacuucgggagcgugggaggcgcucucaauucccuggggaaaggcauccaccagauuuucggagcggccuuuaagucucuguucggcgggaugagcugguuuucccaaauccugaucggaacccuucucauguggcugggccugaacgcuaaaaaugggagcauuucucucaugugccuggcccuuggaggcguucugaucuuccucuccaccgccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10211 - RNA, 2290 nt, Artificial Sequence
  ZIKV (strain MR 766) prME-short variant mRNA Design 1 opt
gggagaaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgaucgggaaagccuucgaagcgacagugcggggagccaagagaauggcuguccuuggcgacaccgccugggauuucgggagcgugggaggcguuuuuaauucccuggggaaaggcauucaccagaucuucggagcugccuuuaagucucucuucggcgggaugagcugguuuucccaaauucugaucggaacacugcuuguguggcucggccugaacaccaagaacgggagcaucucucugaccugccucgcccugggaggcgucaugauuuuccuuuccacagcugugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10212 - RNA, 2302 nt, Artificial Sequence
  ZIKV (strain NatalRGN) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgauugggaaggcuuuugaggccacagugagaggagcuaagcgcauggccguccuuggcgauaccgccugggacuucgggagcgugggaggcgcucucaauucccuggggaaaggcauccaccagauuuucggagcggccuuuaagucucuguucggcgggaugagcugguuuucccaaauccugaucggaacacuucucauguggcugggccugaacaccaaaaaugggagcauuucucucaugugccuggcucuuggaggcguucugaucuuccucuccaccgccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10213 - RNA, 2305 nt, Artificial Sequence
  ZIKV (strain ZikaSPH2015) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcuguggccucuucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgcuuggcaaggcguucagcacaacccugaaaggggcccaacggcucgcugcccugggagauacagcuugggacuuuggcuccauugggggaguguucaauucuaucggcagagccguccaccagguguuugggggcgccuuccgcacccuguuuggaggcaugagcuggaucacccaggggcuuaugggagcucuccugcuguggaugggcguuaacgcgcgggauagauccauugcccucgcuuuccuggccacagggggagugcuugucuuucuggccacgaaugugcaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10214 - RNA, 2305 nt, Artificial Sequence
  ZIKV (isolate Z1106033) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcuguggccucuucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacacuuggcaaggcguucagcaccacacugaaaggggcccaacggcucgcugcccugggagauaccgcuugggacuuuggcuccaucgggggagucuucaauucuauuggcagagccgugcaccagguuuuugggggcgccuuccgcacccuguuuggaggcaugagcuggaucacacaggggcuuaugggagcucuccugcuguggaugggcgugaacgcgcgggauagauccaucgcccucgcuuuccuggccaccgggggaguccuuguguuucuggccacgaauguucaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10215 - RNA, 2293 nt, Artificial Sequence
  ZIKV (strain MR 766) prME-short variant mRNA Design 1 opt
gggagaaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcuccagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcugugggcuuuucggaaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgcuuggcaaggccuuuagcacaacccugaaaggggcucaacgccucgccgcgcugggagacacagccugggauuucggcuccauugggggagucuuuaauucuaucggccgggcugugcaccagguuuucgggggcgccuuuagaacccuguucggaggcaugagcuggauuacccaggggcuuaugggagcucuccugcuguggaugggcgugaacgcccgcgaccgguccaucgcccucgcuuuucuggcgacagggggaguccuuguguuccuggccacgaacguucaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10216 - RNA, 2305 nt, Artificial Sequence
  ZIKV (strain NatalRGN) prME-short variant mRNA Design 1 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcuguggccucuucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgcuuggcaaggcguucagcacaacccugaaaggggcccaacggcucgcugcccugggagauacagcuugggacuuuggcuccaucgggggagucuucaauucuauuggcagagccgugcaccagguuuuugggggcgccuuccgcacccuguuuggaggcaugagcuggaucacccaggggcuuaugggagcucuccugcuguggaugggcgugaacgcgcgggauagauccaucgcccucgcuuuccuggccacagggggaguccuuguguuucuggccacgaauguucaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10217 - RNA, 2284 nt, Artificial Sequence
  ZIKV (strain ZikaSPH2015) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcacccuuggcaaggccuucuccacaacccugaaaggagcgcagagacucgccgcucugggcgacaccgccugggauuucgggucuauuggaggcguguuuaauagcaucgggcgcgcugugcaucaagucuucggaggcgccuuucggacacuguucgggggcauguccuggauuacgcagggacuuaugggcgcccuccugcuguggaugggggugaacgcuagagaccgcucuaucgcgcucgccuuucuggcuaccggaggcguucuuguguuccuggccacaaauguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10218 - RNA, 2284 nt, Artificial Sequence
  ZIKV (isolate Z1106033) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacacuuggcaaggccuucuccaccacccugaaaggagcgcagagacucgccgcucugggcgacacagccugggauuucgggucuaucggaggcguguuuaauagcauugggcgcgcuguccaucaaguguucggaggcgccuuucggacgcuguucgggggcauguccuggaucacccagggacuuaugggcgcccuccugcuguggauggggguuaacgcuagagaccgcucuauugcgcucgccuuucuggcuacaggaggcgugcuugucuuccuggccaccaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10219 - RNA, 2272 nt, Artificial Sequence
  ZIKV (strain MR 766) prME-short variant mRNA Design 1 opt
gggagaaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcacccuuggcaaggcuuucuccacaacccugaaaggagcccagcggcucgcugcccugggcgauaccgcgugggacuuugggucuauuggaggcguguucaauagcaucgggagagccguccaucaaguguuuggaggcgcuuuccgcacacuguuugggggcauguccuggauuacgcagggacuuaugggcgcccuccugcuguggauggggguuaacgcucgggauagaucuaucgcccucgccuuccuggcuaccggaggcgugcuugucuuucuggcgacaaacgugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10220 - RNA, 2284 nt, Artificial Sequence
  ZIKV (strain NatalRGN) prME-short variant mRNA Design 1 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcacccuuggcaaggccuucuccacaacccugaaaggagcgcagagacucgccgcucugggcgacaccgccugggauuucgggucuaucggaggcguguuuaauagcauugggcgcgcuguccaucaaguguucggaggcgccuuucggacacuguucgggggcauguccuggaucacgcagggacuuaugggcgcccuccugcuguggauggggguuaacgcuagagaccgcucuauugcgcucgccuuucuggcuaccggaggcgugcuugucuuccuggccacaaaugugcacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10221 - RNA, 2302 nt, Artificial Sequence
  ZIKV (strain ZikaSPH2015) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgcuugggaaggcuuuuagcacaacccugaagggagcccagagacucgcugcccugggcgauacagccugggacuucggguccaucggaggcguguucaauucuauugggcgcgcugugcaccaagucuuuggcggagcguuccggacccuguuuggcgggaugagcuggaucacccagggacuuaugggcgcccuccugcuguggaugggggugaacgcuagagaucgcuccaucgcccucgccuuccuggcuacaggaggcguucuuguguuucuggccacgaauguccaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10222 - RNA, 2302 nt, Artificial Sequence
  ZIKV (isolate Z1106033) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacacuugggaaggcuuuuagcaccacacugaagggagcccagagacucgcugcccugggcgauaccgccugggacuucggguccauuggaggcguguucaauucuaucgggcgcgcuguccaccaaguguuuggcggagcguuccggacccuguuuggcgggaugagcuggauuacacagggacuuaugggcgcccuccugcuguggauggggguuaacgcuagagaucgcuccaucgcccucgccuuccuggcuacgggaggcgugcuugucuuucuggccaccaaugugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10223 - RNA, 2290 nt, Artificial Sequence
  ZIKV (strain MR 766) prME-short variant mRNA Design 1 opt
gggagaaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgcuugggaaagccuucagcacaacccugaagggagcgcagcggcucgccgcucugggcgacacagccugggauuucggguccaucggaggcguguuuaauucuauugggagagcuguccaccaaguguucggcggagccuuucgcacccuguucggcgggaugagcuggaucacccagggacuuaugggcgcccuccugcuguggauggggguuaacgcucgggacagauccauugcgcucgccuuucuggcuacaggaggcgugcuugucuuccuggccacgaacgugcaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10224 - RNA, 2302 nt, Artificial Sequence
  ZIKV (strain NatalRGN) prME-short variant mRNA Design 1 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgcuugggaaggcuuuuagcacaacccugaagggagcccagagacucgcugcccugggcgauacagccugggacuucggguccauuggaggcguguucaauucuaucgggcgcgcuguccaccaaguguuuggcggagcguuccggacccuguuuggcgggaugagcuggauuacccagggacuuaugggcgcccuccugcuguggauggggguuaacgcuagagaucgcuccaucgcccucgccuuccuggcuacaggaggcgugcuugucuuucuggccacgaaugugcaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10225 - RNA, 2005 nt, Artificial Sequence
  ZIKV (strain ZikaSPH2015) ME variant mRNA Design 1 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggauaucguccuggagcacggaggcugugugacgguuauggcgcaggacaaacccaccguggauauugaacuugucacaaccacagugagcaauauggccgaggugcggucuuauugcuacgaggcuuccaucagcgacauggccucugauucccgcuguccuacccagggcgaggcuuaucuggacaagcaaagcgauacgcaguacgucugcaaaagaacacucguugaccggggguggggaaacggcugugggcuguuuggaaagggcucucuugugaccugcgccaaguucgcguguuccaaaaagaugacagggaaaagcauucagcccgaaaaucuggaauaucgcaucaugcucuccgugcauggaucucagcacagcggcaugauugucaacgauaccggccaugagaccgacgagaauagagccaagguggaaaucacaccuaacagcccccgggcugaggccacgcuugggggauuuggcucccuggggcucgauugcgaaccucgcaccggacuggacuucucugaucuuuacuaccugacaaugaauaacaaacacuggcucguucacaaggagugguuucaugacaucccgcugcccuggcacgcuggcgccgacaccgggacaccucauuggaauaacaaggaagcccuuguggaguucaaagaugcucacgcgaagagacaaaccgucgugguucugggaucccaggagggcgccgugcacacggcucucgccggcgcccuggaagcugagauggacggggccaaaggacggcugagcucuggccaucucaagugucgccugaaaauggauaagcugagacugaaaggggucagcuauucccucugcacagcggcuuuuaccuucaccaagauucccgccgaaacacugcacggaaccgugacagucgaggugcaguacgccggcacggacgggccuuguaagguucccgcucagauggccguggauaugcaaacccuuacaccggucggccggcugaucaccgcuaauccugugauuacagaaucuaccgagaacagcaaaaugaugcucgagcuggaucccccuuuuggagacuccuauaucguuauuggcgugggggaaaagaaaaucacgcaucacuggcauagaagcggaucuaccaucggcaaggccuucgaggcgacaguccgcggggccaaacggauggcugugcugggagacaccgccugggauuuuggcuccguugggggcgcucucaauagccugggaaagggcauucaccagaucuucggggccgcguucaagucucuuuuuggaggcauguccugguucagccagauucugaucgggacacuccugauguggcugggacuuaacaccaaaaacggcuccauuucucucaugugccuggcccucgggggcgugcugaucuuucugagcacggcugucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10226 - RNA, 2005 nt, Artificial Sequence
  ZIKV (isolate Z1106033) ME variant mRNA Design 1 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacgccaaaaacggcuccaucucucucaugugccuggcucucgggggcguccugauuuuucugagcaccgccguguccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10227 - RNA, 1993 nt, Artificial Sequence
  ZIKV (strain MR 766) ME variant mRNA Design 1 opt
gggagaaagcuuaccaugaccagcaucggcauuaucgggcugcugcugacaacggccauggcugccgugacccuucccucccacucuacaagaaagcugcagacccggagccaaacauggcucgagucccgcgaauacaccaaacaucugauuaaggucgagaacuggaucuucagaaauccuggauuugcgcuuguugcuguggccauugccuggcugcucggcucuagcacaucccagaaagugaucuaucuggucaugauccugcucauugcuccggccuacucuauccggugcauuggggugagcaaccgcgacuucguugaaggaauguccggcgggaccuggguggaugucgugcuggagcacggaggcuguguuacggugauggcucaggacaagcccaccgucgauaucgaacuugugacaaccacagugagcaauauggccgaggucagaucuuauugcuacgaggcguccauuagcgacauggccucugauucccgguguccuacccagggcgaggcuuaucuggacaaacaaagcgauacgcaguacguuugcaagcgcacacucguggacagaggguggggaaacggcugugggcuguuuggaaagggcucucuugugaccugcgccaaauucacauguuccaagaaaaugaccggaaagagcauccagcccgaaaaucuggaauaucggauuaugcucuccguccaugggucucagcacagcggcaugaucggcuacgagaccgaugaggaccgcgcuaaaguggaaguuacaccuaacucccccagagccgaggcgacgcucgggggauuuggcagccuggggcuggauugcgaaccucggaccggacuggacuucucugaucuuuacuaucugacaaugaauaacaagcauuggcucgugcacaaggagugguuucacgacaucccgcugcccuggcaugccggcgcugacaccgggacaccucacuggaauaacaaagaagcccuugucgaguucaaggaugcucaugccaaacgccaaaccgugguugugcugggaucccaggagggcgccguccacacggcucucgcgggcgcccuggaagcugagauggacggggccaagggaagacuguuuagcggccaccucaaaugucggcugaagauggauaaacuucgccugaagggggugucuuacagccucugcacagccgcuuucaccuuuaccaagguccccgccgaaacacugcauggaaccgugacaguugaggugcaguaugcgggcacggacgggccuuguaaaauucccguccagauggcuguggauaugcaaacccuuacaccgguuggcagacugaucaccgccaauccugugauuacagaauccaccgagaacucuaagaugaugcucgagcuggaucccccuuucggagacagcuacaucgucauuggcgugggggacaaaaagaucacgcaccauuggcaccgguccggaagcaccaucggcaaagccuuugaagcuacagugagaggggccaagcgcauggcuguucugggagauaccgccugggacuucggcucugucgggggcguguucaauucccucggaaagggcauucaucagaucuuuggggcggccuucaaaagccuguuuggaggcaugucuugguucucccagauucuuaucgggacacugcucguguggcugggacugaacaccaagaauggcagcauuucccuuacgugccucgcucucgggggcgucaugaucuuucugucuacagccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10228 - RNA, 2005 nt, Artificial Sequence
  ZIKV (strain NatalRGN) ME variant mRNA Design 1 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacaccaaaaacggcuccaucucucucaugugccuggcccucgggggcguccugauuuuucugagcacggcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10229 - RNA, 2032 nt, Artificial Sequence
  ZIKV (strain ZikaSPH2015) ME variant mRNA Design 1 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgauaucgugcucgaacacggaggcuguguuaccgugauggcucaggacaaaccuacagucgauauugagcuggugaccacgaccguguccaauauggccgagguccggagcuauugcuacgaggcuucuaucuccgacauggccagcgauucucgcugucccacacaaggcgaagcguaucuugacaagcaguccgauacccaguacguuugcaaaagaacacugguggaccggggguggggaaacggcugugggcucuuuggaaagggcagccuggugaccugcgccaaguucgcuuguuccaaaaagaugacggggaaaucuauucagccugaaaaucuugaguaucgcaucaugcugagcguccauggaucccaacacagcggcaugaucgugaacgauacaggccaugagaccgacgaaaauagagccaagguugagauuacacccaacucuccucgggcugaagccacccucgggggauuuggcucccuggggcuggauugcgagccgcgcaccggacucgacuucagcgaucuguacuaccuuacaaugaauaacaaacacuggcuggugcacaaggaaugguuucaugacaucccccucccuuggcacgccggcgcugacacggggacaccccauuggaauaacaaggaggcgcuggucgaguucaaagaugcccacgcuaagagacagacagugguugugcuuggaucucaggaaggcgccguccacaccgcccuggcuggcgcccucgaggcggaaauggacggggcuaaaggacggcugagcuccggccaucugaagugucgccucaaaauggauaagcugagacuuaaaggggugucuuauagccugugcacagccgccuuuaccuucacgaagauuccugcugagacacuccacggaaccgucaccguggaaguucaguacgccggcacagacgggcccuguaaggugccggcucaaauggccgucgauaugcagacccugacaccugugggccggcuuaucacggcgaaucccguuauuaccgaguccacagagaacagcaaaaugaugcuggaacucgacccucccuuuggagauucuuauaucgugaucggcgucggggagaagaaaauuacccaucacuggcauagauccggaagcacaaucggcaaggccuucgaagcuaccgugcgcggggccaaacggauggcugugcugggagacacggccugggauuucggcucuguugggggcgcgcuuaauucccucggaaagggcauucaccagaucuuuggggccgcuuucaagagccuguuuggaggcauguccugguucucucaaauucuuaucgggacccugcucauguggcugggacugaacaccaaaaacggcagcaucucccuuaugugccucgcccucgggggcguccugauuuuucugucuaccgcugugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10230 - RNA, 2032 nt, Artificial Sequence
  ZIKV (isolate Z1106033) ME variant mRNA Design 1 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagaccguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacgccaaaaacggcagcaucucccuuaugugccucgcucucgggggcgugcugaucuuucugucuacagccgugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10231 - RNA, 2020 nt, Artificial Sequence
  ZIKV (strain MR 766) ME variant mRNA Design 1 opt
gggagaaagcuuaccauggccaucagcggcgugcccguccugggguucuuuauuaucgcuguucucauguccgcccaggagucuugggcggcugugacccugccuagccacuccacaagaaaacuucaaacgcggucucagaccuggcuggaaagccgcgaguacacaaagcaucucauuaagguggaaaacuggaucuucagaaauccgggauuugcccuggucgccguggcuauugccuggcuucugggcuccucuaccagccagaaaguuaucuaucucgugaugauccugcugauugcucccgccuacuccauccggugcauuggggucagcaaccgcgacuucguggagggaaugucuggcgggacauggguugaugugguccucgaacacggaggcugugugaccgugauggcgcaggacaagccuacagucgauaucgagcugguuaccacgaccguguccaauauggccgaggugagaagcuauugcuacgaagccucuauuuccgacauggcuagcgauucucggugucccacacaaggcgaggcuuaucuugacaaacaguccgauacccaguacgucugcaagcgcacacugguggacagaggguggggaaacggcugugggcucuuuggaaagggcagccugguuaccugcgccaaauucacguguuccaagaaaaugacagggaagucuauccagccugaaaaucuugaguaucggauuaugcugagcgugcauggaucccaacacagcggcaugaucggcuacgagaccgaugaagaccgcgcgaaagucgaggugacacccaacucuccuagagccgaagcuacccucgggggauuuggcucccuggggcuggauugcgagccgcggaccggacucgacuucagcgaucuguacuaucuuacaaugaauaacaagcauuggcugguucacaaggaaugguuucacgacaucccccucccuuggcaugccggcgcugacacggggacaccccacuggaauaacaaagaggcccugguggaguucaaggaugcccaugcuaaacgccagaccgucgugguccuuggaucucaggaaggcgcggugcacaccgcccuggcuggcgcccucgaggccgaaauggacggggcuaagggaagacuguuuagcggccaccugaaaugucggcucaagauggauaaacugcgccuuaaggggguuuccuacucucugugcacagccgcguucaccuuuacgaaggugccugcugagacacuccauggaaccgucaccguggaaguucaguaugccggcacagacgggcccuguaaaauuccggugcaaauggccgucgauaugcagacccugacaccugugggcagacuuaucacggcuaaucccgugauuaccgagagcacagagaacuccaagaugaugcuggaacucgacccucccuucggagauagcuacaucguuauuggcgucggggacaaaaagaucacccaccauuggcaccggucuggauccacaaucggcaaagccuucgaggcuaccgugagaggggccaagcgcauggcggugcugggagauacggccugggacuuuggcagcgucgggggcguguucaauucucugggaaagggcauucaucagaucuuuggggcugccuucaaaucccucuuuggaggcaugagcugguucucccaaauucugaucgggacccuucugguuuggcucggacugaacacaaagaauggcucuauuagccugaccugccuugcucucgggggcgugaugaucuuucuguccacagccgucucugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10232 - RNA, 2032 nt, Artificial Sequence
  ZIKV (strain NatalRGN) ME variant mRNA Design 1 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagacaguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacaccaaaaacggcagcaucucccuuaugugccucgcccucgggggcgugcugaucuuucugucuaccgcugugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10233 - RNA, 2011 nt, Artificial Sequence
  ZIKV (strain ZikaSPH2015) ME variant mRNA Design 1 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacaucguccucgagcauggcgggugugugaccguuauggcccaggauaaacccacgguggacauugaacuggucaccacaaccgugagcaauauggcugaggugcgcucuuauugcuacgaggccuccaucagcgauauggcuucugacuccagauguccuacacagggagaagccuaucuugauaagcaaagcgacacccaguacgucugcaaacggacgcugguugaucgcggcuggggcaacggguguggacucuucggcaaggggucucuggugacaugcgcgaaguuugccuguuccaaaaagaugaccggaaaaagcauucagcccgagaaucuugaauauagaaucaugcuguccgugcacggcucucagcauagcgggaugauugucaacgacacaggacacgagaccgaugagaaucgggcuaagguggaaaucaccccuaacagcccccgcgccgaggcuacacucggcggcuucgggucccugggacuggacugcgaaccuagaacgggccucgauuuuucugaccuguacuaccuuaccaugaauaacaaacacuggcugguucauaaggagugguuccacgacaucccgcuccccuggcaugccggggccgauacaggaaccccucacuggaauaacaaggaagcucugguggaguuuaaagacgcgcacgccaagcggcaaacagucgugguucuuggcucccaggagggggcugugcauaccgcccuggccggagcucucgaagccgagauggauggcgcgaaaggccgccugagcucugggcaccugaaguguagacucaaaauggacaagcugcggcuuaaaggagucagcuauucccugugcacggcugccuucacauuuaccaagauucccgccgaaacccuccauggcacagugaccgucgaggugcaguacgcugggacagauggaccuuguaagguucccgcccagauggcuguggacaugcaaacgcugaccccggucggcagacuuaucacagccaauccugugauuaccgaaucuacagagaacagcaaaaugaugcuggagcucgaucccccuuucggggacuccuauaucguuauuggcgugggagaaaagaaaaucacccaccauuggcaccgcagcggcucuacgaucgggaaggcguuugaggccaccguccggggagcuaaaagaauggccgugcugggcgauacagcuugggacuucggguccgugggaggcgcccugaauagccucgggaagggcauucaccagaucuucggagcggccuuuaagucucuguucggcgggauguccugguuuagccagauucuuaucggaacccugcucauguggcugggccugaacacaaagaacggguccauuucucuuaugugccucgcucugggaggcguucugaucuuccucagcaccgccgucuccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10234 - RNA, 2011 nt, Artificial Sequence
  ZIKV (isolate Z1106033) ME variant mRNA Design 1 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaagcaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacgcuaaaaacggguccaucucucuuaugugccucgcccugggaggcguccugauuuuccucagcacagcuguguccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10235 - RNA, 1999 nt, Artificial Sequence
  ZIKV (strain MR 766) ME variant mRNA Design 1 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauuaagguggagaacuggaucuuucggaauccuggcuucgcucugguggccgucgccauugcuuggcuucuggggucuagcaccucccagaaagugaucuaucucguuaugauucugcugaucgccccggcuuacucuauccgcugcauuggagugagcaacagagauuuugucgaaggcauguccgggggaacauggguggacguugugcucgagcauggcgggugugucaccgugauggcccaggauaagcccacgguggacaucgaacuggucaccacaaccguuagcaauauggcggaggugcggucuuauugcuacgaggccuccauuagcgauauggcuucugacucccgcuguccuacacagggagaagccuaucuugauaaacaaagcgacacccaguacgugugcaagagaacgcuggucgaucggggcuggggcaacggguguggacucuucggcaaggggucucuggugacaugcgcuaaauuuaccuguuccaagaaaaugacaggaaagagcauccagcccgagaaucuugaauaucgcauuaugcuguccguucacggcucucagcauagcgggaugaucggauacgagaccgacgaggauagagccaaaguggaagucaccccuaacagcccccgggcggaggccacacucggcggcuucgggucccugggacuggacugcgaaccucgcacgggccucgauuuuucugaccuguacuaucuuaccaugaauaacaagcacuggcuggugcacaaggagugguuccaugacauuccgcuccccuggcacgcuggggccgauacaggaaccccucauuggaauaacaaagaagcucugguugaguuuaaggacgcccacgccaaaagacaaacaguggucgugcuuggcucccaggagggggcuguccacaccgcgcuggccggagcucucgaagccgagauggauggcgccaagggccggcuguucagcgggcaucugaaaugucgccucaagauggacaaacugagacuuaagggagugucuuacagccugugcacggcugccuuuacauucaccaagguucccgcggaaacccuccacggcacagugaccgucgaggugcaguaugcugggacagauggaccuuguaaaauccccguucagauggccguggacaugcaaacgcugaccccggucggccggcuuaucacagccaauccugugauuaccgaauccacagagaacucuaagaugaugcuggagcucgaucccccuuuuggggacagcuacaucgugauuggcguuggagauaaaaagaucacccaucacuggcauagauccggcagcacgauugggaaggcuuucgaagccaccguccgcggagcuaagcggauggccgugcugggcgacacagcgugggauuucgggucugugggaggcgucuuuaauucccuggggaagggcauccaccagaucuucggagccgcuuuuaaaagccucuucggcgggaugucuugguuuucccagauucugaucggaacccuucugguguggcucggccugaacacaaagaaugggagcauuucccugaccugccuugcccucggaggcguuaugaucuuccugucuacggcugugagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10236 - RNA, 2011 nt, Artificial Sequence
  ZIKV (strain NatalRGN) ME variant mRNA Design 1 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacacaaagaacggguccaucucucuuaugugccucgcucugggaggcguccugauuuuccucagcaccgccguguccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10237 - RNA, 2029 nt, Artificial Sequence
  ZIKV (strain ZikaSPH2015) ME variant mRNA Design 1 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggauauuguccucgagcacggcggcugcgugaccguuauggcucaggacaagcccacaguggauaucgaacuggucaccacgaccguguccaauauggccgaggugcgcagcuauuguuacgaggcgucuauuuccgacauggccagcgauucuagaugcccuacacagggggaggcuuaucuugacaaacaauccgauacccaguacgucuguaagcggacacugguugaccgcggauggggcaacgggugcggacucuuuggcaaggggagccuggugaccugugccaaauucgcuugcuccaagaaaaugacgggaaagucuauccagcccgaaaaucuugaauauagaauuaugcugagcgugcauggcucccagcacagcggcaugaucgucaacgauacagggcaugagaccgacgagaaucgggccaaaguggaaaucacaccuaacucuccccgcgccgaggcuacccucggaggcuuugggucccugggacuggauugugaaccuagaaccggccucgacuucagcgaucuguacuaccuuacaaugaauaacaagcacuggcugguucacaaggagugguuucaugacauuccgcuccccuggcacgcgggggccgacacgggaaccccucauuggaauaacaaagaagcucugguggaguucaaggaugcccacgccaaacggcaaacagucgugguucuuggcucucaggagggcgcugugcacaccgcccuggcgggggcucucgaagccgagauggacggagccaagggccgccugagcuccgggcaucugaaaugcagacucaagauggauaaacugcggcuuaagggagucucuuauagccuguguacagcugccuuuaccuucacgaagauccccgcugaaacacuccacggcaccgugaccgucgaggugcaguacgccgggacagacggcccuugcaaaguucccgcgcagauggccguggauaugcaaacccugacaccggucggaagacuuauuacggcuaauccugugaucaccgaauccacagagaacagcaagaugaugcuggagcucgaucccccuuuuggcgacucuuauauuguuaucggggugggagagaaaaagaucacccaucacuggcaucgcuccggcagcacaauugggaaagccuucgaagcuaccguccggggagccaagagaauggcggugcugggcgacacggccugggauuuugggucugugggcggagcucucaauucccugggcaaggggauccaccagauuuucggagccgcuuucaaaagccuguuuggcgggauguccugguucucucagauccuuauuggaacccugcucauguggcugggccugaacacaaagaacgggagcaucucccuuaugugccucgcccugggcggaguucugaucuuucucucuaccgccgucagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10238 - RNA, 2029 nt, Artificial Sequence
  ZIKV (isolate Z1106033) ME variant mRNA Design 1 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacgccaagaacgggagcauuucccuuaugugccucgcccugggcggaguccugaucuuucucucuacagcugugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10239 - RNA, 2017 nt, Artificial Sequence
  ZIKV (strain MR 766) ME variant mRNA Design 1 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucaucaaaguggagaacuggauuuuccggaauccuggcuuugcucugguggccgucgcuaucgccuggcuucugggguccucuaccagccagaaggugauuuaucucguuaugauccugcugaucgcgccggccuacuccauucgcuguaucggagugagcaacagagacuucgucgaaggcaugucugggggaacauggguggauguugugcucgagcacggcggcugcgucaccgugauggcucaggacaaacccacaguggauauugaacuggucaccacgaccguuuccaauauggccgaggugcggagcuauuguuacgaggcuucuaucuccgacauggccagcgauucucgcugcccuacacagggggaagcguaucuugacaagcaauccgauacccaguacguguguaagagaacacuggucgaccggggauggggcaacgggugcggacucuuuggcaaagggagccuggugaccugugccaaguucacgugcuccaaaaagaugacaggaaaaucuauucagcccgagaaucuugaauaucgcaucaugcugagcguucauggcucccagcacagcggcaugauuggguacgagaccgaugaggacagagcuaagguggaagucacaccuaacucuccccgggccgaggcuacccucggaggcuuugggucccugggacuggauugugaaccucgcaccggccucgacuucagcgaucuguacuaucuuacaaugaauaacaagcauuggcuggugcacaaagagugguuucacgacaucccgcuccccuggcaugccggggccgacacgggaaccccucacuggaauaacaaggaagcucugguugaguucaaagaugcgcaugccaagagacaaacaguggucgugcuuggcucucaggagggcgcuguccacaccgcccuggccggggcucucgaagccgagauggacggagcgaaaggccggcuguuuagcgggcaccugaagugccgccucaaaauggauaagcugagacuuaagggaguguccuacucucuguguacagcugccuucaccuuuacgaaaguucccgccgaaacacuccauggcaccgugaccgucgaggugcaguaugcugggacagacggcccuugcaagauccccguucagauggccguggauaugcaaacccugacaccggucggacggcuuauuacggcuaauccugugaucaccgaaagcacagagaacuccaaaaugaugcuggagcucgaucccccuuucggcgacagcuacauugugaucgggguuggagacaagaaaauuacccaccauuggcacagaucuggcuccacaaucgggaaggccuuugaagcgaccguccgcggagccaagcggauggcugugcugggcgauacggccugggacuucgggagcgugggcggagucuucaauucucugggcaaagggauccaucagauuuuuggagcugccuucaagucccucuuuggcgggaugagcugguucucccagauccugauuggaacccuucugguguggcucggccugaacaccaaaaaugggucuaucagccugacaugccuugcgcucggcggaguuaugauuuuucuguccacagccgugucugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10240 - RNA, 2029 nt, Artificial Sequence
  ZIKV (strain NatalRGN) ME variant mRNA Design 1 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacacaaagaacgggagcauuucccuuaugugccucgcccugggcggaguccugaucuuucucucuaccgccgugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10241 - RNA, 2305 nt, Artificial Sequence
  ZIKV (strain ZikaSPH2015) prME-short variant mRNA Design 1 opt
gggagaaagcuuaccauggcaauaagcggaguaccaguuuuagguuucuuuauaauagcugucuuaaugucagcacaggaaucaugggcaguaacuagaagagggucagccuauuauauguaccuagauagaaaugacgcuggugaagcgauaaguuuuccaaccacuuuaggcaugaauaaaugcuauauacaaauaauggaccuuggacauaugugcgaugcuacaaugucauacgaaugcccaauguuagaugaagguguagaaccagaugacguagauugcugguguaauacaacgaguacauggguaguauauggaacuugccaucauaagaaaggagaagcaagaagaucaaggagagcaguuacauuaccaucucauucuacuagaaaacuacaaaccagaucucaaacuugguuagaaaguagagaauacacaaaacaucuaauaagaguagaaaauuggaucuuuagaaauccaggauuugcauuagcagcagcagcaauagcauggcuauuaggaagcucaacaagucaaaaaguaauauacuuaguaaugauacuucuaauagcaccagcauauucaauaagauguauagguguaucaaauagagauuuugucgaaggaaugucaggugguacauggguagauauagucuuagaacacggaggaugugucacaguuauggcucaagauaaaccaacaguagauauugagcuaguaacaacgacaguaucaaacauggccgaagucagaucauacuguuaugaagcaucaauaagcgacauggcaagugauaguagauguccgacacaaggagaagcauaucuagacaaacaaucagauacacaguauguaugcaaaagaacauuaguagauagaggcuggggaaacgguugcggauuauuugguaaaggcagccucguaacaugcgcaaaauuugcaugcucgaagaaaaugacagguaaaaguauacaaccagaaaaccuagaauacagaaucauguuaaguguucaugguagucaacauaguggaaugauaguuaacgauacaggacacgaaacugaugaaaauagagcaaaaguagaaauaacaccuaauucuccaagagcagaagcaacacuagggggauuugguucauuaggauuagacugugaaccaagaacagguuuagauuuuucagauuuauauuaccucacaaugaauaacaaacauugguuaguacauaaagaaugguuucaugauauuccauugccuuggcaugccggugcagacacaggcacaccacauuggaauaauaaggaagcacuuguggaauuuaaagaugcacaugcaaaaagacaaacaguuguaguacucgguucacaagaaggagcaguacacaccgcauuagcaggcgcacucgaggcagaaauggauggggcaaaagggagacuaaguaguggacaucugaaaugcagauuaaaaauggacaaacuacgacuaaaaggaguaucauauagucuuugcacagccgcguucacguucacuaaaauaccugcugaaacauuacacggaacgguaacuguagaaguacaauaugcaggaacagauggaccaugcaaaguuccugcgcaaauggcagucgacaugcaaacauuaacaccaguagggagguuaauuacagcuaauccaguuauaacagaaaguacagagaauaguaaaaugaugcuagaauuagauccaccuuuuggggacucuuacauaguaauaggaguaggagaaaagaaaauaacccaucauuggcaucgaaguggaaguacaauaggaaaagcauuugaggcaacaguaagaggagcaaaaagaauggcaguacuuggagauacagccugggacuucggcagugucggaggagcacuaaauaguuuaggaaaagguauacaucaaauuuuuggagccgccuuuaaaucauuauucggagggauguccugguuuagucaaauauuaauuggcacauuauuaauguggcuaggauuaaauaccaaaaauggcucaauaucauuaauguguuuagcguuagguggaguacuaaucuuuuugagcacggcagucagugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10242 - RNA, 2305 nt, Artificial Sequence
  ZIKV (isolate Z1106033) prME-short variant mRNA Design 1 opt
gggagaaagcuuaccauggcuauaagcggaguaccaguccuagguuucuuuauaaucgcugucuuaaugucagcacaagaaucgugggccguaaccagaagaggaagugcauauuauauguauuuagaccgaaaugaugcaggcgaagcgauaucauuuccaacgacauuaggaaugaauaaauguuauauacaaauaauggauuuaggacacacaugcgaugcaaccaugucuuacgaauguccaauguuagacgaaggaguagaaccagaugacguagacuguugguguaauacaaccaguaccuggguaguuuacggaacaugucaucacaagaaaggagaagcaagaagaaguagacgagcaguaaccuugccaucacauucaacaagaaaauuacaaacaagaucacaaacaugguuagaaagucgagaauauacaaaacaucuaauaagaguagaaaacuggauauuuaggaacccuggauuugcacucgcagcagcugcaauugcaugguugcuaggaagcucuacuucccaaaaaguuauuuauuuaguaaugauauuauuaauagcaccagcauauucaauuagauguaucgguguaucuaauagagacuuuguagaaggaaugagcggagguacuuggguagaugucguauuagaacauggaggauguguaacaguaauggcccaagauaaaccaacgguagacauagaauuagucacuacaacuguuucaaauauggcugaaguuagaucauacuguuaugaagcaaguauaucagauauggccagugacuccagauguccaacccaaggagaagcauauuuagacaaacaaagugacacacaauauguaugcaaaagaacucuaguagauagaggcuggggaaauggaugcggauuauuuggaaaggggaguuuaguaacaugcgcaaaauuugcaugcucaaagaaaaugacaggaaaaaguauccaaccagaaaauuuagaauauagaauaauguuaucaguacauggaucgcagcacagcggaaugauuguuaacgacacaggacaugaaacagaugaaaacagagcaaaaguugaaauuacaccaaacucaccaagagcagaagcgacauuaggaggauuuggaucacuagguuuagauugugaacccagaacuggacuugauuucagugacuuauauuaucuuacgaugaauaauaaacacuggcuaguucacaaagaaugguuucaugauauaccacuuccauggcaugcaggagcagauaccggcacaccucacuggaacaauaaagaggcccuaguagaauuuaaagacgcucaugcaaaaagacagacuguugugguauuaggcucacaagaaggagcaguucacacugcgcuagcaggggccuuagaggcagaaauggacggcgcaaaagguagacucucaagcggacauuuaaaaugcagacugaaaauggauaaauuacgacuaaaaggaguuaguuauagccuauguacugccgcauuuacuuucacaaaaauaccagcagaaacacugcauggaacuguaacgguagaaguacaauacgccgguacagacggaccuuguaaaguaccagcacaaauggccguagauaugcaaacacuaacuccuguugguagacuaauaacugcaaauccuguaauaacagaaagcacagaaaauucaaaaaugauguuagaauuagauccaccuuuuggagauucauauauaguaaucgggguuggagaaaagaaaauuacacaccauuggcaucgaucaggaucaacaaucgguaaagccuuugaagcgacaguaagaggugcaaaaagaauggcaguauuaggagauacagcaugggauuuugguucgguaggaggagcauuaaauucacuaggaaaagguauucaccaaauauuuggagcagccuuuaaaaguuuauuuggaggaaugaguugguuuagucaaauuuugauaggaaccuuauuaauguggcuuggacucaacgcaaagaacggaucaauuagcuuaaugugucuagcguuaggaggaguuuugauauuccuaucaacagcaguaagugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10243 - RNA, 2293 nt, Artificial Sequence
  ZIKV (strain MR 766) prME-short variant mRNA Design 1 opt
gggagaaagcuuaccauggccauaucaggaguaccaguauuagguuuuuucauaauagcaguacucaugucagcacaagaaucaugggcgauaacaagaagaggaucagcauauuacauguauuuagauagaucagaugcgggaaaagcaauuuccuuugcaacaacauuaggugugaacaaaugccauguacaaauuauggaucuuggucacaugugcgacgcaacaaugucguacgaaugcccuaugcuugacgaaggaguugaaccagaugacgucgauuguugguguaacacaaccucaacauggguugucuacgguacuugucaucauaaaaaaggggaagcaaggagaucaagaagagcuguaacacuaccaagucauucaacuagaaaauuacaaacaagaagccaaacauggcuagaaucucgagaauauaccaaacacuuaauaaaaguagaaaacuggauauuuaggaauccaggauucgcauuagucgccguagccauugccugguuacugggaucuaguacaagccaaaaagucauuuaccuaguaaugauacuuuuaauagcaccagcauacucaauucgguguauaggugucaguaacagggauuuuguugaagguaugaguggaggaacauggguagauguuguacucgaacacggcggaugugucacaguaauggcacaagauaaaccaacuguagacauagaacuaguaacaacaacuguaucaaacauggcggaaguuagaucauacuguuaugaagcaaguauaucagauauggcaucagauucacgcugcccaacacaaggcgaagcauauuuagauaaacaaagcgauacacaauauguaugcaaacgaacacuaguagacagaggcuggggcaauggaugcggauuauucggcaaaggaagucuuguaaccugugcaaaauuuacaugcucaaaaaaaaugacagguaaaaguauacaaccagaaaaucuagaauaucgaauaauguuaagcguacauggaucacaacauucuggaaugauuggauaugaaacggaugaagauagagcaaaaguagaaguaacaccaaauuccccaagagcagaagccacacuagguggcuuuggaucucuaggcuuagauugugaaccaagaacuggauuagauuuuucagauuuauauuauuugacaaugaauaauaaacauugguugguacauaaagaaugguuucacgauauaccuuuaccauggcaugcuggagcagacacaggaaccccacauuggaacaauaaagaagcauuagucgaguucaaagaugcccaugcaaaaagacaaacgguaguaguucuaggaucccaagaaggagcgguacauacagcacucgcaggagcacuagaagccgaaauggauggugcuaaaggaagauuauuuucaggacaucuuaaauguagauuaaaaauggauaaauuaagacuuaaaggaguaucuuauagucucuguacugcggcuuuuacauuuacaaaaguaccagcagaaacguuacaugguacaguaacaguagaaguacaauacgcaggaacagacgguccauguaaaauuccuguacaaauggcaguagauaugcaaacucugacaccaguagguagauuaauaacagcuaauccuguaauaacagagucaaccgagaacucaaaaaugaugcuagaauuagauccaccuuuuggagauucauauauagucauaggcguaggagacaaaaaaauaacacaucacuggcacagaucaggaaguacuauagggaaggcauuugaagcaacgguaagaggcgcaaaaagaauggcaguauuaggagauaccgcaugggauuuuggaaguguuggugguguguuuaacucuuuagggaaagggauacaucaaauauuuggagcagcauuuaaaagcuuguuuggagguaugucaugguuuucacaaauacuaauaggaacauugcuaguaugguuaggauuaaauacuaaaaauggaagcauaagcuuaacaugcuuagcauuagguggaguaaugauauuuuuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10244 - RNA, 2305 nt, Artificial Sequence
  ZIKV (strain NatalRGN) prME-short variant mRNA Design 1 opt
gggagaaagcuuaccauggcuauuucugggguuccaguauuaggauucuuuauaauagcaguauuaaugucagcacaagaaaguugggcaguaacaagaagaggaagugcauacuauauguauuuggacagaaaugacgcuggagaagccauaaguuuuccaacaacauugggcaugaacaaauguuauauacaaauaauggauuuaggacauaugugugaugcaacaaugucauacgaauguccuaugcuagaugaaggagucgaaccagacgauguagauuguuggugcaauacaacuucaacauggguaguuuauggaaccugucaucauaagaaaggggaagcaagaaggaguagaagggcaguaacuuuacccucucauagcacaagaaaauuacaaacaagaucacaaacuuggcucgaaagcagagaauauacuaaacauuuaauaagaguagaaaauuggauuuucagaaauccaggauuugcucuagcagcagcagcaauagcaugguuacuugguuccaguacaagucaaaaaguaaucuaccuuguaaugauacuucuuauugcuccagcguauucaauaagguguauuggaguaaguaacagagacuucguagaagguaugucuggaggcacguggguagacguaguauuagaacacgguggguguguaacuguaauggcucaagauaaaccaacuguugauaucgaauuagugacaacaacaguuucaaacauggcugaaguacgaagcuacugcuacgaagcaucaauaagugauauggcaagugauagucgaugcccaacacaaggagaagcauaucuagacaaacaaagugauacacaauauguauguaaaagaacacuuguagauagaggauggggaaaugguugugggcuauuuggcaaagggagcuuagucaccugugcaaaauuugcuuguagcaagaaaaugacaggaaaaagcauacaaccagaaaaucuagaauauagaauaauguuaaguguccauggaucacaacauaguggaaugauaguaaaugacaccggacacgaaacugacgaaaaucgagcaaaaguggaaauaacaccaaauagucccagggccgaagcuacauuaggagguuuuggaucacuaggacuggauugugaacccaggacaggguuagauuucagcgauuuauauuauuuaacaaugaacaauaaacauugguugguacauaaagaaugguuucaugauauaccauuacccuggcaugcuggugcugauacaggcacaccucauuggaacaauaaagaagcauuaguagaauuuaaagaugcgcaugcaaaaagacaaacaguugucguuuuaggaagucaagaaggcgcaguacauacugcucuagcaggagcauuagaagcugaaauggauggagcaaaaggcagacugucaaguggacauuuaaaaugucgacuaaaaauggauaaauugcgauuaaaaggaguaucauauuccuuaugcacugcagcuuuuacauuuacaaaaauaccugcagaaacguuacauggaacaguuacaguagaaguucaauacgccggaacagauggaccauguaaaguaccagcacaaauggcaguagacaugcaaacauuaacaccugucggacgacuaaucacagcaaauccaguuauuacagaaucaacagaaaauaguaaaaugaugcuagaauuagauccaccauucggagauucauacauaguaauaggaguuggagaaaagaaaauaacacaccauuggcaucgaagcggaaguacaauaggaaaagcguucgaagcuacaguccguggagcaaaaagaauggcaguauuaggagauaccgcaugggauuuuggaaguguaggcggagcauuaaauaguuuaggaaaagguauacaccaaaucuuuggagcagcauucaaaucacuauuuggaggaaugagcugguuuucgcagauacugauagguacuuuauuaauguggcuaggauuaaauacgaaaaacgguagcauaucauugauguguuuagcacucgguggaguacuaauauuuuuaucuacagcuguauccgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10245 - RNA, 2284 nt, Artificial Sequence
  ZIKV (strain ZikaSPH2015) prME-short variant mRNA Design 1 opt
gggagaaagcuuaccauggauuggacauggauuuuauuucuagucgcagcagcuacaagaguacacuccguaacaagaagaggaucggcauacuauauguauuuagacagaaacgaugcaggggaagcaauaucauuuccaacaacucuugguaugaauaaauguuacauacagauaauggauuuaggacacaugugcgaugccacuaugucguacgagugcccaauguuagacgaagggguggagccggaugauguagauugcugguguaacacuaccucuacauggguagucuauggaacaugucaccacaagaaaggagaagcaagaagaaguagacgagcaguaaccuuaccaagucauucaacaagaaaauuacaaacaagaucacaaacaugguuagaaucaagggaauauacaaaacauuuaauuagaguagaaaacuggauauuuagaaauccugguuuugcuuuggcagcagccgcuaucgcuugguuauuaggaagcagcacaucacaaaaaguaauauauuugguaaugauuuuacucauagcccccgcguauaguauucgauguauagguguaucuaauagagacuucguagaaggaaugucaggaggaacuuggguagacaucguauuagaacacggaggauguguaacaguaauggcucaagacaaaccgacaguagauauagaauugguaacaacaacuguuucuaauauggcagagguacgaucauacuguuaugaagcaagcaucagugauauggcuucagacagccgauguccaacacaaggugaagcauacuuagauaaacaaagcgacacacaauauguaugcaaaagaacguuaguagauagaggcuggggaaaugguugcggguuauucggaaaaggaucauugguaacaugcgcaaaauuugcauguucaaagaaaaugacuggaaaaucuauacaaccugaaaaucuagaauauaggauaauguuaaguguucauggaucucaacacucaggaaugauaguaaaugacacaggacacgaaacggaugaaaauagagccaaaguagaaauaacaccaaauucaccgagagcagaagcgacauugggaggauuugggucacuaggauuagauugugaaccgagaaccggguuagauuuuucugaucucuauuaucuaacaaugaauaauaaacauugguuaguacacaaagaaugguuccaugauauuccauuaccuuggcacgcaggagccgauacagguacuccacacuggaacaauaaagaagcauuaguagaauuuaaagacgcacaugcaaaaagacaaacaguaguaguauuaggaagucaagaaggcgcaguacacaccgcucuagcaggagccuuagaagcagaaauggauggagcaaaggguagauugucuucaggccaucuaaaauguagacuaaaaauggauaaacuaagauuaaaaggaguaagcuacucuuuaugcacagcagcauuuacguuuacaaaaauaccagcagaaaccuuacauggaacuguuacuguagaaguacaauaugcaggaacagauggaccauguaaaguuccagcacaaauggcaguagauaugcaaacauuaacaccaguaggaagauuaauuacagcaaauccaguaauuacagaaucaaccgaaaacucaaaaaugauguuagaauuagacccaccuuucggagacucauauauaguaauaggaguaggagaaaagaaaauuacacaccauuggcaccgauccggaucaacaauaggaaaagcauucgaagcuacaguacgaggcgcaaaaaggauggcagucuuaggagauacagcaugggauuuuggaagcguaggaggagcacuuaacuccuuagguaaaggcauacaucaaauauuuggagcagcguuuaaaucauuauuuggggguaugucuugguuuagccaaauacucauagguaccuuauuaauguggcuaggacuuaauacuaaaaacgguucaauuucauuaauguguuuagccuuaggagguguuuuaauauuucuuaguacagcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10246 - RNA, 2284 nt, Artificial Sequence
  ZIKV (isolate Z1106033) prME-short variant mRNA Design 1 opt
gggagaaagcuuaccauggauuggacauggauauuauuuuuaguggcagcagcaacaagagugcacucagugaccaggagaggaagugcauauuauauguauuuagauagaaaugacgcgggagaagcaauaucauucccaacuacguuaggaaugaauaaauguuauauacaaauaauggauuuaggucauacaugugaugcaacaaugucuuacgaauguccgauguuagacgaaggaguagaaccagaugacguagacugcuggugcaauacaacaaguacuuggguaguauacggaacaugccaucacaaaaaaggagaagcuagaagaucucgaagggcaguaacuuuaccaagucauucuacacgaaaauugcaaaccaggucacaaacaugguuagaaucaagggaauacacaaaacaucugauaagaguagaaaacuggauauuuagaaaucccggguuugcauuagcugcagcagcaauagcauggcuuuuagguucaucaacaucucaaaaaguaauauaucuugugaugauacucuuaauugcaccugcuuacaguauuagguguauaggugucucaaauagagacuuugucgaagggaugaguggugguacauggguugauguugucuuggaacaugguggauguguaacaguaauggcacaagauaaaccaaccguagauauagaauuagucacaacgacaguaucuaacauggcagaaguuagaucuuauugcuaugaagcgucaauaucugauauggccucggacucaagaugcccaacacaaggcgaagcauaucuagauaaacaaucagauacccaguauguauguaaaagaacauuaguugauagagguuggggaaaugguugcggacuauuuggcaaaggaucauuaguaacaugugcaaaauucgcauguagcaaaaaaaugacaggaaaaucaauucaaccagaaaauuuggaguauagaauaaugcuaagugugcacggaagccagcauaguggaaugauuguaaaugauacaggacaugaaacugacgagaauagagcgaaaguagaaaucacaccaaauucaccaagagcugaagcuacacuaggaggauuugguaguuuaggccucgauugugaaccaagaacaggauuagacuucuccgaucuauauuauuuaacaaugaauaauaaacacuggcuaguucauaaagaaugguuucaugauauaccuuuaccuuggcaugcaggagcagauacaggaacuccucauuggaacaauaaagaagcacuaguagaauuuaaagaugcacacgcaaaaagacaaacaguagucguacuaggaagucaagaaggagcaguucauacagcuuuagcaggagcauuagaagcagaaauggauggagcaaaagggagauuaucaucaggacaccuaaaauguagauuaaaaauggauaaauuaagauuaaaaggaguaucauacucauuguguacagcagcauuuacauuuacaaaaauaccagcagaaacauuacauggaacagucacgguugaaguacaauacgccggaaccgacggaccaugcaaaguaccugcacaaauggcaguagauaugcaaacacuaacaccaguaggacgacuaauaaccgcgaauccaguaauaacagaaaguacagaaaauagcaaaaugauguuagaacuagauccuccauuuggagauucauacauaguaauuggagucggggaaaaaaagauuacucaccacuggcaucgaucgggcaguacaauaggaaaagcauuugaagcaacaguacgcggagcaaaaagaauggcaguacuaggagacaccgcaugggauuucgguucaguagguggagcauuaaauucauuagguaaaggaauacaccaaauauucggagccgccuuuaaaaguuuguuuggcggaaugaguugguuuagccaaauauugaucggaaccuuacuaauguggcuggguuuaaaugcaaaaaaugguagcauaagucuaaugugcuuagcacuggguggaguacuaauauuuuuaucaacggcaguaucagcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10247 - RNA, 2272 nt, Artificial Sequence
  ZIKV (strain MR 766) prME-short variant mRNA Design 1 opt
gggagaaagcuuaccauggauuggaccuggauauuauuuuuaguagcagcagcuacuagggugcauucaauaacaagaagaggaucagcuuacuauauguauuuagacagaagcgacgcaggaaaagcaaucagcuuugcuacaacacuagguguaaauaaaugucauguacaaauaauggauuuaggacauaugugugaugcaacaaugaguuacgaauguccuauguuagaugaagguguggaaccugacgauguagauuguuggugcaauacuacuagcacuuggguagucuauggcacaugucaucauaagaaaggcgaagcaaggagaaguagacgugcaguaacauugccaucucacaguacacgaaaauuacaaacuagaucacagacauggcuugaaucaagagaauauacaaaacacuuaauaaaaguagaaaauuggauauucagaaauccuggguucgcacuuguggcugucgcuauagcuugguuacuaggaaguaguacgagucaaaaaguuauauaucuuguuaugauauuacuaauagcaccagcauacaguauaagauguauagggguuucuaacagagacuuuguugaaggaaugucagguggaacauggguagacguaguauuagaacacggaggauguguaacuguaauggcacaagauaaaccaacuguugauaucgaacucguaacaacaacagugagcaauauggcggaagugagaucauacuguuaugaggcaucaaucucagacauggcaucagauucaagauguccaacucaaggugaagcguaucuggacaaacaaucagacacacaauauguauguaaaaggacauuaguugauagaggaugggguaauggaugcggacuauucggaaaagggagcuuaguaaccugugcuaaauuuacauguaguaaaaagaugacaggaaaaucaauacaaccagaaaauuuagaauacagaauaaugcuaucaguccauggcagucaacacagcggaaugauugguuaugaaacggacgaggauagagcuaaaguugaaguaacgccuaauaguccuagagcagaagcuacacuaggaggauuuggaucacuaggauuagacugcgaaccacgaacaggauuagauuuuagugauuuauauuaccuaacgaugaauaacaaacacugguuaguacacaaagaaugguuucacgauauaccauuaccauggcaugcaggcgcugauacaggaacaccacauuggaacaauaaagaggcuuugguagaauuuaaagacgcacaugcuaaaaggcagacaguaguaguauuaggaucacaagaaggagcugugcauacagcacuugcaggagcacuagaagcagaaauggacggggcaaaaggacgauuguucucaggacauuuaaaguguagacuaaaaauggauaaacuaagacuaaaagguguaucauauagccuauguacugccgcauuuacguuuacuaaagucccagcagaaacucuacauggaaccguaacugucgaagugcaauaugcagguacagauggcccuuguaaaauaccaguucaaauggcaguggacaugcaaacauuaacaccgguaggaagauuaauaacagcaaauccgguuauaacggaaucaacagaaaauaguaaaaugaugcuagaauuggauccaccauuuggugauucauauauaguaauaggcguaggagacaagaaaauaacacaucacuggcauagaagcggaucaacaauagguaaagcauuugaagcuacuguaagaggagcaaaaagaauggcaguccuaggugauacagcuugggacuuugguagcguaggaggaguguuuaauucacucggaaaagguauucaccaaaucuuuggagccgcuuuuaaaucauuauucggagguaugagcugguucucacaaauccuaauaggaacacuauuagugugguugggacuaaauacuaaaaaugguagcauaucacuaacauguuuagcauuaggagggguuaugauauuucuaaguacagcuguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10248 - RNA, 2284 nt, Artificial Sequence
  ZIKV (strain NatalRGN) prME-short variant mRNA Design 1 opt
gggagaaagcuuaccauggauuggacauggauauuauuuuuaguagcagcagcaacgagaguacauaguguaacaagacgagguuccgcauacuacauguauuuagauagaaaugaugcgggagaagccauaucauucccgacgacauuaggaaugaauaaauguuauauccaaauaauggauuuaggacacaugugugaugcaacaaugucauaugaauguccaauguuagacgaaggaguugaaccugaugauguagauuguugguguaacacaacuagcacguggguugucuauggaacaugucaucauaagaaaggagaagcaagacggaguaggagagcaguaacauugccaucacacaguacaagaaaacuacaaacacgaagucaaacaugguuagagagccgagaauauacaaaacaucuaauaagaguagaaaauuggauuuucagaaauccagguuuugcauuagcagcagcagcaauagccugguuauuaggaucaucaacaagucaaaaaguaauauauuuagucaugaucuuauuaauagcaccagcguauucaauacgauguauuggaguaucuaacagggauuucguagaagguaugucaggaggaacauggguagauguaguacuugagcauggaggaugugugacaguaauggcacaagauaaaccaacgguugauauagaauuaguaacaacaacaguaucaaacauggcagaaguaagaaguuauugcuaugaagcaagcauaucagauauggcuucugacagucgauguccaacacaaggagaagcauauuuagacaaacaaucugauacucaauaugucugcaaaagaacauugguagauaggggguggggaaauggauguggauuguuuggaaaaggaagucuaguaacgugugcaaaauuugcuugcucgaaaaaaaugacuggaaaaaguauacaaccagaaaaucuugaauauagaauaauguuaaguguucauggaagucaacauucaggaaugauuguaaaugauacuggacaugaaacggacgaaaauagggccaaaguagaaauaacaccuaauaguccuagagcugaagccacauuaggaggauucggaucauuaggacucgacugugaaccaaggacaggacuagauuucucugacuuguauuacuuaacaaugaauaauaaacauugguuaguacacaaagaaugguuucacgauauaccacuaccauggcaugcgggagcugauacagguacuccacacuggaauaauaaagaagcacucguagaauuuaaagacgcacacgcaaaaagacaaacaguuguaguauuagguucacaagagggcgcaguacauacagcauuagcaggugcuuuagaagcugaaauggacggagcaaaaggaagauuaucaaguggacaccuaaaaugcagauugaaaauggauaaauuacgauuaaaaggaguaucuuauagccuuuguacugccgcauuuaccuuuacaaaaauaccagcagaaacauuacauggaacuguaacaguagaaguacaauacgcuggcacugacggaccauguaaaguaccggcucaaauggcgguagauaugcaaacauuaacaccaguaggucgccuaauaacagcaaauccaguaauaacugaaagcacugagaauuccaaaaugauguuagaauuggauccaccuuuuggagauucauacauaguaauuggaguaggugaaaaaaaaauaacacaucacuggcauagauccggaucaacaauaggaaaagcauuugaagcaacaguucguggggcuaaaagaauggcaguacuaggagauacagccugggauuucggaucgguaggaggugcauuaaacucauuaggaaaagguauacaucaaauauuuggagcagccuucaaaagucucuuuggaggcaugaguugguucagucaaauauugauaggaacucuauuaauguggcucggcuuaaauacaaaaaaugguucaauuucauuaauguguuuagcauuaggaggaguauuaauuuucuuaucaaccgcaguauccgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10249 - RNA, 2302 nt, Artificial Sequence
  ZIKV (strain ZikaSPH2015) prME-short variant mRNA Design 1 opt
gggagaaagcuuaccaugggaaaaagaucagcuggaaguauaaugugguuagcaucauuagcuguaguaauagcaugcgcaggagcuguaacaagaagaggaagcgcauauuauauguaccuagauagaaacgacgcaggagaagcuaucucuuuuccaacaacauuaggaaugaauaaauguuauauacaaauuauggauuuaggacauaugugcgacgcaacaaugucauaugaauguccuauguuagacgaaggaguagaaccagacgauguagauuguugguguaauacaacaaguacuuggguaguuuauggcacaugccaucauaagaaaggggaagcucgaagaagcagacgagcaguaacauuaccaagucauagcacaagaaaacuacaaacaagaagccaaacaugguuagaaucuagagaauauacuaaacauuuaauacgcguagaaaacuggauauucagaaauccaggauuugcacuagcagcagcagcaauagcaugguuauuaggaucaaguacaucacaaaaaguaauauacuuaguaaugauacuauuaauagcaccagcuuacucaauaagaugcauaggaguaucaaaucgugacuuuguagaaggcaugagcgggggcacauggguagauauuguacuagaacauggugguuguguuacaguuauggcucaagauaaaccuaccguugauauagaguuaguaacaacaacaguaagcaauauggcagaaguaagaucauacuguuacgaagcaucaauaagcgauauggcaucagauaguagaugcccaacucaaggagaagcauacuuagauaaacaaucagauacacaauauguaugcaagcgaacccuaguggaccgaggauggggaaauggauguggacuauuuggaaaaggcucucuuguuacaugugcaaaauuugcauguucuaagaaaaugacaggaaaaucaauacaaccugaaaacuuagaauacagaauaauguuaagcguucauggaagucaacacucagguaugauaguaaaugauacaggacacgagaccgaugaaaacagagcaaaaguagaaauaacacccaacucaccaagagcagaagcaacccuuggcgguuuuggaaguuuaggauuagauugugagccuagaacugguuuagauuucucagauuuauauuauuuaacuaugaauaauaaacauuggcuaguccauaaagaaugguuucaugauauaccuuugccauggcaugcgggugcagauaccggaacaccacacuggaacaacaaagaagcacuuguagaauuuaaagaugcccacgcaaaaagacaaacuguaguaguacuuggaagucaagaaggagcaguucauacugcauuagcaggagcauuagaagcagaaauggauggagccaaaggaagauuaaguucuggacaucuuaaauguagguuaaaaauggauaaauuaagacuaaaaggcguuucauacucauuauguacagcagcauucaccuucacaaaaauaccagcugaaacauuacacggaacaguaacaguugaaguucaauaugcaggaacugaugggccauguaaaguaccugcacaaauggcaguagauaugcaaacacuaacaccaguaggaagacuaauaacagcaaacccuguaauuacggaaucuacagaaaacagcaaaaugauguuagaguuggauccacccuuuggagauagcuauauaguuauaggagugggugaaaagaaaauaacgcaucauuggcacagaagugguaguacaauaggaaaagcauuugaggcaaccguaagaggggcaaaaaggauggcaguccuaggagacacagcuugggacuuuggaagcguaggcggggcccuuaauuccuuaggaaagggaauacaccaaauauuuggagcagcauuuaaaucauuauucgguggcaugucuugguuuucucaaauacuaauaggaacauuauuaauguggcuuggacuaaauaccaaaaauggcucaaucucauuaaugugucuugcuuuaggagguguacuaauauuuuuaaguacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10250 - RNA, 2302 nt, Artificial Sequence
  ZIKV (isolate Z1106033) prME-short variant mRNA Design 1 opt
gggagaaagcuuaccauggguaaaagaucagcuggaucaauaaugugguuagccucacuagcaguuguuauagcaugugcuggagcgguaacuagaagagguagugccuauuacauguaccuagauagaaacgaugcaggagaagccauaucauuuccaacaacauuagguaugaauaaaugcuauauucaaauaauggauuuaggacacacaugugaugcaacaaugucuuaugaauguccaauguuagaugaaggaguugaaccagaugauguagauuguugguguaauacaacaaguacauggguuguauacggaacgugucaucauaaaaaaggagaagcacgaagaaguagacgagcugucacauuaccaagucauagcacucguaaauuacaaacaagaagucaaacuuggcuagaaagcagagaauauacgaagcaucuaauaaggguugaaaacuggauauucagaaacccaggauuugcuuuagcagcugcugcaauagcauggcuauuaggaagcucaacaagucaaaaagucauauauuuaguaaugauacuucuaauagcaccagcauacaguauuagaugcauaggaguaaguaauagggauuuuguagaaggaaugaguggagguacauggguugacguaguauuagaacauggaggauguguaacaguaauggcacaagacaaaccuacaguagacauagaauuaguaacaacuacaguuucuaauauggccgaaguacgaagcuauuguuaugaggcaucaauaucagauauggcaucagacucaagauguccaacucaaggggaagcguaucuagauaaacaauccgacacccaauacguauguaaacgaacacuuguagauagaggauggggaaacgguuguggauuauuugguaaagguaguuuaguaacuugcgcaaaauuugcauguucaaaaaagaugacaggcaaaucaauacaaccagaaaaccuggaauauagaauaauguuaucaguacauggcucacaacauagugguaugaucguuaacgauacuggacaugaaacagaugaaaaucgagcgaaaguagaaauaacgccaaauucaccuagagcugaagcaacauuaggaggauuugggagcuuaggacuugacugugaaccuagaacaggauuagauuucagcgaucuauacuaucuuacgaugaauaauaaacauuggcucguacacaaagagugguuucaugauauuccucuuccauggcacgcaggagcugauacugggacaccacauuggaauaauaaagaagcuuuaguagaauucaaagaugcacacgcaaaaagacaaacaguaguuguguuaggaucucaagaaggagcgguacauacagcauuagcaggagcccuagaagcagagauggauggagcaaaaggacgguuaucaucaggacaucuaaaauguagacuuaaaauggacaaauuaagacuaaaaggaguaucuuauucauuaugcacagcagcauuuaccuuuacaaaaauaccggcagaaacacuucauggaacaguuacaguagaaguacaauacgcaggaacagauggcccaugcaaagucccagcacaaauggcuguagauaugcaaacauuaacuccaguagguagacuuauaacagcaaauccgguaauaacagagucaacggaaaauucaaaaaugauguuagaacuagauccaccauuuggagacaguuacauaguuauuggcgucggagaaaaaaaaauaacacaucacuggcauaggagcggaaguacaauuggaaaagcauucgaagcuacaguuagaggagccaaaagaauggcuguauuaggagacacugcgugggacuuuggaaguguaggaggcgcauuaaauagcuuagguaaaggaauacaucaaauauuuggugcggcauucaaaucacuguucggaggaaugaguugguuuucacaaauacuaaucggaacuuuacuaaugugguuagguuuaaaugcaaaaaauggaucaauaaguuuaaugugccuggcauuaggaggaguauugauauuuuuaagcacagcagugucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10251 - RNA, 2290 nt, Artificial Sequence
  ZIKV (strain MR 766) prME-short variant mRNA Design 1 opt
gggagaaagcuuaccaugggaaaaagaucagcagggaguauaaugugguuagcaagucuagcaguugucauagcgugcgcaggugcaaucacuagaagaggaagcgcauauuacauguauuuagauagaagugaugcaggaaaagcaauuucauuugcuacaacauuaggcgucaauaaaugucauguacaaaucauggauuuaggucauaugugugaugcaaccaugagcuacgaauguccaauguuagaugaaggaguagaaccugaugacguagacugcugguguaauacaacaaguacauggguaguauauggaacgugccaucacaaaaaaggagaagcaagaagaagccgaagagcggucacccuaccaagucauagcacuagaaaauuacaaacaaggagucaaacauggcuagaaagcagagaauauacaaaacacuuaauaaaaguagaaaauuggauauuucguaauccaggcuucgcacuaguagcaguagccauagcaugguugcuuggaucaucgacaagucaaaaaguuaucuauuuaguaaugauauuauuaauagcgccugcauacucaauacgauguauaggaguaucuaacagagauuucguagaaggaaugucuggagguacuuggguagauguaguucuggaacaugguggauguguuacuguaauggcccaagacaaaccaaccguagauauugaacuaguaacuacuacuguaagcaacauggcggaaguacgaucauauuguuacgaagcaaguauaagugauauggcaucagauucuagaugcccgacccagggagaagcauauuuagauaagcaaagugacacccaauacguauguaaaagaacauugguagauagaggauggggaaacggauguggauuauucggcaaaggaaguuuaguaacaugugcuaaauuuaccugcaguaaaaaaaugacaggcaaaaguauacaaccagaaaauuuagaauacagaauaaugcuaagcguacauggaucucaacauucaggaaugauaggauaugaaacagaugaagauagggcuaaaguagaagucacaccuaauagcccaagagcggaagcgacccuggguggguuuggaucauuaggauuagauugcgaaccgagaaccggauuagauuuuagugauuuauauuauuuaacaaugaacaauaaacauugguuagugcauaaagagugguuccaugacauaccacuaccauggcaugcaggugcagacacuggaacaccacauuggaauaauaaagaagcauuagucgaauucaaagaugcucaugcgaaaagacaaacaguagugguucuaggaucucaagaaggagcaguacacacagcauuagcaggagcgcuagaagcagaaauggauggcgcaaaaggaagauuauucagcggucauuuaaaauguagauuaaaaauggauaaauuaagacuuaaaggaguaucauauucucuaugcacagcagcauuuacuuuuacuaaaguaccagccgaaacauuacauggcacgguaacugucgagguacaauaugcagguacagacggaccuuguaaaauaccaguacaaauggcaguggauaugcaaacauuaacuccaguaggcaggcuaauaacagcuaauccaguaauaacagaaucaacugaaaacagcaaaaugauguuggaauuagauccaccauuuggcgauuccuauauaguaauagggguaggagauaaaaaaauaacacaccauuggcacaggaguggaaguacaauagggaaagcauuugaagcgacaguaagaggagcaaaaaggauggcaguacuaggagauacagcaugggauuuugguagcgugggagguguauuuaacucacuaggcaaggggauacaucaaauauuuggcgcagcauuuaaaagcuuauuuggaggaaugaguugguuuucacaaauucugauaggaacucuuuugguaugguuaggauuaaauacaaaaaacgguucuauaaguuuaacaugucuagcauuaggggguguaaugauauuucuaaguacugcaguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10252 - RNA, 2302 nt, Artificial Sequence
  ZIKV (strain NatalRGN) prME-short variant mRNA Design 1 opt
gggagaaagcuuaccaugggaaaaagaucagcagguucaauaaugugguuagcaucauuagcgguaguaauagcaugugcaggagccguaacgcguagagguucagcuuauuauauguaucuugauagaaacgaugcuggugaagcaauaucauuuccaaccaccuuaggaaugaauaaauguuauauacaaauaauggaccuaggacauaugugugacgcgacaaugucauacgagugcccuauguuagacgaaggaguagaaccagaugacguagauuguugguguaauacaacgucaacguggguaguauauggcacaugccaccauaagaaaggugaagcucgcagaagcaggagagcaguuacauugccaagccauucgacuagaaaauugcaaaccagaagucaaacaugguuagaaaguagagaauauacuaaacaucugauacgaguagagaacuggauauuuagaaauccaggauucgcguuagcagcggcagcaauagccugguuauuaggaaguucaacaagucagaaaguaauauaucuaguaaugauacuauuaauugcuccugcauauucaauaagauguauaggaguaucaaauagagauuuuguagaaggaaugucuggcggaacuuggguagauguaguacuagaacacggggguugugucacuguaauggcacaagauaaaccaacaguggauauagaauuaguaaccacaacaguaaguaauauggcagaaguaagaucauauuguuaugaagcaaguauaagugacauggcaucagauagcagauguccaacacaaggcgaagcauacuuagauaaacaauccgacacacaauacguauguaaaagaacauuagucgauagaggauggggaaauggauguggauuauuuggaaaagggucauugguaacaugugcaaaauucgcauguagcaagaaaaugacuggaaaaucaauacaaccagaaaauuuggaauaucgaauaauguuaaguguacauggcucucaacauucagggaugauuguaaacgacacuggacaugaaacagaugaaaacagagcaaaaguagaaauaaccccgaauaguccuagagcagaagcaacacuagguggauuugggucauuagguuuggauugugaaccaagaacaggcuuagauuuuagugaccuauauuaccugacuaugaauaauaaacauuggcuaguacauaaagaaugguuucaugauauaccauuaccauggcacgcaggagcugauaccggaacuccacauuggaauaacaaagaagcauugguugaauuuaaagaugcucacgcaaaaagacaaaccguaguaguacuaggcucacaagaaggagcgguccauacagcacuagcaggagcacuagaagcagaaauggacggggcaaaaggaagguuaucaaguggacauuuaaaguguagacuaaaaauggacaaauuacgauuaaaaggaguaucauauucauuauguacagcagcauuuacuuuuacuaagaucccagcagaaacauugcacggaacaguaacuguagaaguucaauaugcaggaacugauggaccaugcaaaguaccugcucaaauggcuguugacaugcaaaccuuaacccccguaggacgauuaauaacagcaaauccgguuauaacagaaucaacugaaaauaguaaaaugauguuagaacuagauccaccauuuggugauaguuacauaguuauaggaguaggagaaaagaaaauaacacaucauuggcauaggagcggaucaacaauagggaaagcauuugaagcaacaguaagaggagccaaaagaauggcaguauuaggagauacggcgugggauuuuggaagcguuggaggcgcauuaaauucccuaggaaaaggaauacaucaaauauucggagcagcauuuaaaucauuauuugguggaaugucuugguuuagucaaauacuaauaggaacauuauuaaugugguuaggauuaaauacuaaaaacggaucaauaagccugaugugcuuagcacuagguggaguacuaaucuuuuugaguacagcagugucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10253 - RNA, 2305 nt, Artificial Sequence
  ZIKV (strain ZikaSPH2015) prME-short variant mRNA Design 1 opt
gggagaaagcuuaccauggcaauaagcggaguaccaguauuaggauuuuuuauaauagcaguuuuaauguccgcucaagagagcugggccguuacuagaagaggaagugcauauuauauguaucucgauagaaaugacgcaggagaagcgauaucauuuccaacaacauuaggaaugaauaaaugcuauauacaaauuauggaucuaggacauaugugugaugcaacaaugaguuacgaauguccaauguuagaugaaggcguagaaccugaugauguagacuguuggugcaacacaacuucaacauggguaguauacggaacgugucaucacaaaaaaggggaagcacgaagaucaagaagggcaguaaccuuaccaucacacucaacuagaaaauuacaaacuagaagucaaacauggcuagaaucaagagaauauacaaaacauuuaauucgaguagaaaacuggauauucagaaauccaggauuugcacuagcagcagcggcaauagcaugguuacuaggaucaucaacuucacaaaagguaaucuaucuaguuaugauacuucucauagcaccagcuuacaguauuagaugcauugguguaucuaaucgagauuuuguugaaggaauguccggaggaacguggguagacauaguuuuggaacauggaggauguguaacggugauggcacaagacaaaccaacaguagauauugaauuagugacaacaacaguuucaaauauggcugaagucagaagcuauuguuaugaagcaaguauaagugauauggccagugauucaagaugcccuacacagggggaagcauaucuugauaaacaaucugauacucaauaugucuguaaaagaacuuuaguugauagaggauggggcaauggauguggcuuauucggaaaaggaaguuuaguaacaugugcuaaauucgcauguucaaaaaaaaugacaggaaaaagcauacaaccugaaaaucuagaauaucguauaauguuaaguguacacggaucacaacacucaggaaugauaguuaaugauacuggacaugaaacagaugaaaacagagcaaaaguagagauuacaccaaauaguccgcgcgcugaagcaacauugggaggauuuggaagccuagguuuagacugugaaccaagaaccggucuagauuuuucagaccuauacuauuugacaaugaauaacaaacauuggcuaguucauaaagaaugguuucaugauauaccacuacccuggcacgcaggagcagauacaggaacaccucauuggaauaauaaagaagccuuaguagaauucaaagaugcacaugccaaaagacaaacaguaguaguauuaggaucacaagaaggagcuguucauacagcacucgcaggcgcauuagaagcugaaauggauggagcuaaaggacgacuaucuucuggacacuuaaaaugucgguuaaaaauggauaaauuacgauuaaaaggaguaucauauagccuauguacugcggcauuuaccuucacaaaaauaccagcagaaacacuacauggaacagucacgguagaaguacaguaugcaggaacagauggaccauguaaaguaccagcucaaauggcaguugacaugcaaacacuaacaccaguaggaagacuaauaacugcaaauccuguaaucaccgaaaguacugaaaacaguaaaaugaugcuugaauuagauccaccguuuggagauagcuauauaguaauaggaguuggagaaaaaaaaauaacccaccauuggcacaggaguggaucaacauuaggaaaagcuuuuucuacaacauugaaaggagcgcaacgucuagcugcauuaggagacacagcuugggauuuuggaucaauaggaggaguauuuaauucaauaggaagagccgugcaccaaguauucggaggagccuuuagaaccuuauucggcggaaugaguuggauaacacaaggacuaaugggagcucuauuacuauggaugggaguuaaugccagagauagauccauugcacuggccuuuuuagcgacaggagggguauuaguauuuuuagcaacaaauguacaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10254 - RNA, 2305 nt, Artificial Sequence
  ZIKV (isolate Z1106033) prME-short variant mRNA Design 1 opt
gggagaaagcuuaccauggcaauaagcggaguaccaguauuaggauucuuuauaauagcaguacuaaugucagcucaagaaaguugggccguaacaagaagaggauccgcauauuauauguaucuagauagaaaugaugcuggugaagcaauaucuuucccuaccacauuaggaaugaauaaauguuauauacaaauuauggaucugggacacacaugugaugcaacgaugucuuacgaguguccaauguuagacgaagguguugaaccagacgauguugauuguuggugcaacaccacaucaacuuggguaguauaugguacaugucaucacaaaaaaggcgaagcgagaagaucaaggagagccguaacauuaccaagucacucaacuaggaaauuacaaacaagaucacaaaccugguuagaaucaagagaauauacaaaacauuuaauaagaguagaaaauuggaucuuucgaaacccaggauuugcuuuagcugcagcagcaauagcuugguuauuaggaucaagcacaucacaaaaaguaauauauuuaguaaugauauuacuaauagcuccagcauacuccaucagauguauuggugucuccaauagagauuucguugaaggaaugagcggaggaacuuggguagauguaguuuuagaacauggcggauguguaacuguaauggcacaagauaaaccaacaguagacauagaguuaguuacaacaaccguauccaauauggcugaaguaagaagcuauugcuaugaagcuucaauaucugauauggcaagugacucaagaugcccaacacaaggugaagcauaucuagacaaacaaucagacacacaauauguauguaaaaggacacuaguagacagaggauggggaaaugguuguggcuuauuugggaaagggaguuuagucacaugcgcaaaauucgcauguucaaaaaaaaugacaggaaaaucaauccaaccagaaaaucuagaauaucguauaaugcuaucuguucauggaucucaacauagcggaaugauuguaaaugacacaggacacgaaaccgaugaaaacagagcaaaaguagaaauaacaccaaauuccccaagagccgaagcaacacuaggagguuuuggaucuuuaggacucgauugugaaccaagaacaggauuggauuucagcgaccuuuauuacuuaacaaugaauaauaaacacugguuaguacauaaagagugguuccaugauauuccauuaccuuggcacgcaggagcugauacaggaacuccacacuggaauaauaaagaagcauuaguagaauucaaagaugcacacgcaaaacgacaaacuguaguaguauugggaucacaagaaggagcagugcauaccgcauuagcuggagcacuagaggcagaaauggauggagcaaaaggccgauuaucaucaggacaucuuaaaugucgucuaaaaauggauaaauugagacuaaaaggcguaucauauucacuuuguaccgcugcuuuuacuuuuaccaaaauaccagccgaaacucuacaugguaccguaacagucgaaguucaauaugcagggacagauggaccauguaaaguuccagcacaaauggcagucgacaugcaaacauuaacgccgguaggaagguugauuacagcaaauccaguaauuacagaaagcacagaaaauucaaaaaugauguuagaauuagauccacccuuuggagauaguuauauaguaauaggaguaggagaaaaaaaaauuacacaccacuggcaccggucaggaucuacucuaggaaaagcuuuuaguacuacauuaaaaggagcacaaagauuagcagcacuaggagauacagccugggauuuuggaucuauagguggaguguuuaacuccauaggaagagcuguacaccaaguuuuuggcggugcuuuuagaacucuuuuuggugguaugucauggauaacacagggacuuaugggggcuuuacuacuguggaugggaguaaacgccagagauagaucuauagcacuagccuuucuagcaacaggaggaguauuagucuucuuagcaacuaauguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10255 - RNA, 2293 nt, Artificial Sequence
  ZIKV (strain MR 766) prME-short variant mRNA Design 1 opt
gggagaaagcuuaccauggccauaaguggaguaccuguauugggauucuuuauaauagcgguauuaaugucagcacaagaaucaugggcgauaacaagaaggggaagcgccuauuauauguacuuagauagaagcgaugcaggaaaagcaauaaguuuugcaacuacucuaggaguaaauaaaugccauguucaaauaauggauuuaggacacaugugugaugcuacaaugucuuaugaauguccgauguuagacgaaggagucgaaccugacgauguggauugcugguguaacacaacuucaacauggguaguauacggaacuugucaucauaaaaaaggugaagcgcgaagaucccgaagagcaguaacucucccuagucacucaacacgaaaguuacaaacaagaagucaaacuugguuagagaguagagaauauacaaagcacuuaauaaaaguagaaaauuggauuuuuaggaauccagguuuugcgcuuguagcaguagcaaucgcuugguuauuaggaucaucaacaucacaaaaaguaauauacuuaguaaugauauuacucauagcaccagcauacaguauaagauguauugggguaaguaaucgagauuuuguggaaggaaugagugguggaacauggguggauguaguacuugagcacggaggcugcguaacuguaauggcucaagauaaaccaacaguagauaucgaauuaguaacuacuacaguuucaaacauggcugaaguaagaucguauuguuaugaagcgagcauaucagauauggccagugacucaagaugccccacgcaaggagaagcauaucuugauaaacaaagugauacucaauauguauguaaaagaacauuaguagaccgaggauggggaaauggcuguggauuauucgguaaaggaaguuuaguaacaugcgcaaaauuuacauguucaaaaaaaaugacaggaaaaagcauucaaccggaaaaccuagaauaucgaauuauguugucgguucacggaagucagcauagcggaaugauaggauaugaaacagaugaagauagagcaaaaguagaaguaacaccaaauaguccacgugcagaagcaacucucggcggguuuggaagucuaggacuagauugugaaccaagaacaggacuagauuuuagugaucuauacuauuuaacaaugaauaauaaacauugguuaguccauaaagaaugguuucaugauauaccacuuccauggcaugcuggagcagauacaggcacaccacauuggaauaauaaagaagcucuaguagaguuuaaagacgcccaugcaaaaagacagacagugguuguacuagguagccaagaaggagcuguucauacagcauuagcaggagcccuugaagcagaaauggauggagcuaaaggaagauuauuuaguggacauuuaaaaugcagacucaaaauggauaaacuuagacuaaaagguguaucuuacagucuaugcacagccgcauuuacauuuacaaaagucccagcagagacacuacacggaacagugacaguagaaguacaauaugcaggcacugauggaccaugcaaaauacccguacaaauggcaguagauaugcaaacguuaaccccaguaggaagacuaaucacugcaaacccaguaauuacagaaaguacugagaauucaaaaaugaugcuagaauuagauccaccauucggagacaguuacauagugauaggaguaggagauaaaaaaauuacacaucauuggcauagaucagguaguacauuaggaaaagcauuuagcacaacauuaaaaggagcacaaagauuagcagcauuaggcgauacagcaugggauuuugggagcauagguggcguauucaacucuauaggcagggccgugcaucaaguauuugguggagcauucagaacucuauuuggaggcaugucauggauuacacaagguuuaaugggagcauuacuauuauggaugggaguaaaugcaagagauagaaguauagcauuagcguuuuuagcaacaggaggaguuuuaguauucuuagcaacuaauguccacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10256 - RNA, 2305 nt, Artificial Sequence
  ZIKV (strain NatalRGN) prME-short variant mRNA Design 1 opt
gggagaaagcuuaccauggcaauuucaggaguaccaguauuaggauucuuuauuauagccguacuaaugucugcacaagaaagcugggcggugacaagaaggggaagcgcauacuauauguaucuagacagaaaugaugcaggagaagcaauaucuuuuccuacaacauuaggaaugaauaaauguuauauacaaauaauggacuuaggacauaugugugaugcaacgaugagcuaugaaugcccgaugcucgacgaagguguagaaccagaugauguagauuguugguguaauaccacuagcacauggguagucuauggaacgugccaucauaaaaagggcgaagcccgaagaucuagacgagcaguaacguugccaucucauaguacaagaaagcugcaaacaagaagucaaacauggcuagaaucgagagaauauacaaaacacuuaauuagaguagaaaauuggauauuuagaaauccaggauuugcuuuagcagcugcagcaauagccuggcuauuaggaucaucaacaagucaaaaagugauauauuuaguaaugauacucuugauagcaccagccuauucaauaagauguauagguguaucaaacagggauuuuguggaaggaaugaguggaggaacuuggguagacgucgucuuagaacauggaggauguguaacaguuauggcacaagauaaaccaacaguagauauagaauuagucacaacuacuguaucuaauauggcagaaguaaggucauacugcuaugaagcaucaauuagcgauauggcuagugauaguagaugcccaacucaaggagaagcauaucuagacaaacagucagauacacaauauguaugcaaaagaacacuuguagauagaggguggggaaacggauguggacuuuuugggaaaggcagcuuaguaacaugugcaaaauuugcaugcaguaagaaaaugacuggaaaaaguauacagccagaaaaccuagaauacagaauaauguuaaguguacacggaucucaacauaguggaaugauaguaaaugauaccggacacgaaacugaugaaaaucgagcuaaaguagaaauaaccccaaacaguccgagagcagaagcaacuuuaggaggauuuggaaguuuaggacuagacugugaaccaagaacaggacuugacuuuucugaucucuauuacuuaacaaugaauaauaaacacuggcuaguacauaaagaaugguuucaugauauaccacuaccauggcaugccggugcagauacuggcacaccucauuggaauaacaaagaggcuuuaguagaauuuaaagaugcacaugcaaaaagacaaacaguaguagugcuaggaucacaagaaggugcaguacacaccgcacuagccggagcauuagaagcugaaauggauggugcaaaaggaaggcuaucaucaggacauuuaaaauguagguuaaaaauggauaaacuaagauuaaaaggaguaucauauucauuauguacugcagcauucacauuuacaaaaauaccggccgaaacgcuacauggaacuguaacaguugaaguucaauaugcgggaacagauggaccgugcaaaguaccagcacaaauggcaguagauaugcaaacucuaacaccaguuggaagauugauaacagcuaauccaguuauaacagaaaguacagaaaacaguaaaaugaugcuagaauuagauccaccguuuggagauucuuacauuguuauaggaguaggugagaagaaaauuacucaucacuggcauagaaguggcucaacacuaggaaaagcauucagcacuacacuuaaaggagcacaaagauuagcagcucuaggggauacagccugggacuucggcucaaucggaggagucuucaauaguauagggagagcaguacaccaaguauuuggaggagcauuuagaacauuauuuggagguaugagcuggauaacucaagguuuaaugggagcacuucuccuauggaugggugucaacgcaagagaccguaguauagcuuuagcuuuucuagcaacaggaggaguauuaguauucuuagcaacaaacguccaugcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10257 - RNA, 2284 nt, Artificial Sequence
  ZIKV (strain ZikaSPH2015) prME-short variant mRNA Design 1 opt
gggagaaagcuuaccauggauuggacauggauauuauuuuuaguagcagcugcaacaagaguacauaguguaacaaggcgcggaagcgcuuacuauauguaucuggauagaaacgaugcaggagaagcuauaucauuuccuaccacacuuggcaugaauaaauguuauauccaaauaauggaucuuggucauaugugcgacgcaaccaugaguuacgaaugcccaaugcuagaugaagguguagaaccugaugaugucgauuguuggugcaacacgacuucgacuuggguaguauaugguacaugucaucacaaaaaaggagaagcuagaagaaguagaagagcagucacauuaccaucacauucaacaaggaaauuacagacaagaagucaaacauggcuagaaucaagagaauauaccaaacauuuaauaagaguugaaaauuggauauucagaaauccaggauuugcauuagcagcugccgccauagcaugguuauuagggaguucaacaucacaaaaaguaauuuacuuaguuaugauucuuuuaauagcaccugcauauagcauuagauguauuggaguaaguaauagagauuuuguggaaggaaugucugguggaacauggguggauaucguacuggaacauggaggauguguaacuguaauggcgcaagauaaaccaacuguagacauagaauuaguuacaacuacaguaucaaauauggccgaaguuagaaguuauuguuaugaagcaucaauaagugauauggcaucagauaguagguguccaacacaaggagaagcuuauuuggauaaacaauccgacacacaauacguaugcaaaaggacucuaguugauagaggauggggaaauggaugcggauuauucgguaaaggaucauuaguuaccugugcuaaauucgcguguucuaaaaaaaugacagggaaaaguauucaaccagaaaaccuagaauacagaauuaugcuuagugugcauggaagccaacauucaggaaugauugucaacgacacaggucaugaaacagaugaaaaucgagcaaaaguagaaauaacaccuaauucaccacgugcagaagcaacauuaggaggauuuggaucauuaggauuagauugugaaccaaggacaggauuagauuucagcgacuuauacuaucugaccaugaauaauaaacacugguuaguacacaaagaaugguuccaugauauaccauuaccauggcacgcaggagcagacacaggaacaccacacuggaauaauaaagaggcccuuguggaauucaaagaugcacaugcaaaacgacaaacaguaguaguacuuggaucacaagagggagcaguucauacagcauuagcaggagcacuugaggcagaaauggacggugcaaaaggaagauuaaguaguggacauuuaaaauguagacuaaaaauggacaaacuaagauuaaaaggaguuagcuauaguuuauguacagcagcauucacauucacaaaaauuccagcagaaacauuacacggaacagucacaguagaaguacaauaugcaggaacagacggaccauguaaaguuccggcacaaauggcaguagauaugcaaacauuaacaccaguuggacguuuaauaacagcuaauccaguaauaacugaaagcacggaaaauucuaaaaugaugcuagaacucgauccaccuuuuggagauucuuacaucguaauaggagugggggaaaaaaaaauuacucaccacuggcauagaaguggaucaacauuagguaaagcauucaguacaaccuuaaaaggagcacaacgacuagcagcauuaggcgacacagcaugggauuuugguucgauaggaggaguguuuaauucaauaggacgcgcaguucaucaaguuuuuggaggagcauuuagaacauuauuuggaggaaugucauggauaacacagggacuuaugggagcccuauuauuauggaugggagugaaugcuagagauagaucaauagcucuagcauucuuagcaacaggugguguauuaguguuucuagcaacaaauguacacgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10258 - RNA, 2284 nt, Artificial Sequence
  ZIKV (isolate Z1106033) prME-short variant mRNA Design 1 opt
gggagaaagcuuaccauggacuggacuuggauacucuuuuuaguagcugcagcaacaagaguacacucaguaacacgaaggggauccgcauauuauauguauuuagauagaaacgaugcaggcgaagcaauuucauuuccaacaacauuaggcaugaauaaaugcuauauucaaauaauggaccuagggcauacaugcgaugccacuaugagcuaugaauguccaauguuagaugaaggaguggaaccagaugauguagacugcugguguaauacaacaaguacauggguuguauauggcacaugccaucauaaaaaaggggaagcaagaagauccagaagagcuguaacauuaccuagccauaguacaagaaaauuacaaacaagaagccaaacauggcuagaaucaagagaguauacaaaacaccuaauaagaguagaaaauuggauauuuagaaacccagguuucgcauuggcagcagcagcaauugcgugguuacuaggaucaucaacaucacaaaaaguaauauaucuaguaaugauauuauuaauagcaccagcuuauucaauaagauguauaggcguaaguaauagagauuuuguagaaggaaugagcggaggaacauggguggauguaguauuagagcauggaggauguguaaccguaauggcacaagauaaaccaacaguugauauagaguugguuacuacaacuguuucaaauauggcagagguacguucuuacugcuaugaagcaaguaucagcgauauggcaagugacucacguugcccaacucagggggaggccuauuuagacaaacaauccgauacacaauauguuuguaaaagaacacuaguagacagaggauggggaaacggaugugguuuauuuggaaaaggcaguuuagucacuugugcaaaguucgcauguaguaaaaaaaugacagguaaaagcauccaaccagagaaccuagaauacagaauaauguuaaguguucacggaucucaacauagcggaaugauugugaacgauacuggucaugaaacggaugaaaauagagcuaaaguagaaauuacaccaaauagucccagagcagaagcaacccuaggcggauucggaucauugggacuugacugcgaaccuagaaccggacuugauuuuucugacuuguacuacuuaacaaugaauaauaaacacugguuaguucauaaagaaugguuccaugauauaccacugccauggcacgcaggagcagauacugguacaccucauuggaauaauaaagaagcauuaguugaauucaaagacgcacaugcaaaaagacaaacaguaguaguauuaggaagccaagaaggagcaguacacacagcacuagcaggagcuuuggaagcagaaauggacggugcuaaaggaagauugagcaguggacaucuaaaaugucgacuuaaaauggauaaauuaagauuaaaagguguaagcuauucacuauguacugcagcauucacauuuacgaaaauaccagcagaaacucuacacgguacaguuacaguagaaguccaauaugcaggaacagauggaccauguaaaguucccgcacaaauggcaguggacaugcaaacauuaacuccgguuggaagauuaauaacugcaaauccagugauuacggaaucgacagaaaauucaaaaaugaugcuugaauuagacccuccuuuuggagauucauacauaguaaucgguguaggugaaaaaaaaauuacacaucauuggcaucggucagguucaacuuuagggaaagcauuuucgacaacacuaaaaggcgcacaaagauuagcagcacuaggcgacacagcaugggauuucggaaguauaggaggaguuuuuaauagcauaggaagagccguacaucaaguauuuggaggagcuuuucggacucuauuuggaggcaugucauggauaacacaagguuuaaugggggcauuauuauuauggaugggaguuaaugcacgugauagaagcauagcguuagcauuuuuagcaacuggaggaguauuaguauucuuagcaacaaacguacaugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10259 - RNA, 2272 nt, Artificial Sequence
  ZIKV (strain MR 766) prME-short variant mRNA Design 1 opt
gggagaaagcuuaccauggacuggacauggauacuauuucuaguagccgcagcgacuagaguacauucaauuacaagaagaggaagcgcauauuauauguauuuagauaggucagaugcugggaaagcaauaucauucgcaacuacuuuggguguaaacaaaugccacguacaaauaauggaucuaggccauaugugugaugcaacaaugucauaugaauguccaauguuagacgaagguguagaaccagaugauguugauugcugguguaacacaaccucaaccugggugguuuaugguacuugucaccacaagaaaggugaagcuagaaggaguaggagggccguaacacuuccaucacauagcacaagaaaacuucaaacuagaucacaaacaugguuagaaucaagggaauacacaaaacaucuaaucaaagucgaaaauuggauauuuagaaacccaggauuugcucuaguugcaguagccauagccuggcucuuaggaucaagcacuucacagaaaguuauauauuuaguuaugauacuauuaauagcacccgcuuauuccauaagauguauaggagugaguaaucgagacuuuguagaaggaaugucaggugguacguggguggauguaguauuagaacauggaggauguguaacaguuauggcacaagacaaaccaacaguagauauagaauuagucacaacaacaguaucaaauauggcagaaguuagaucauauugcuacgaagcgucaauaagugauauggccucagauaguagauguccuacacaaggagaagcguauuuagacaaacaaucagacacacaauauguuuguaaaaggacucuaguugauagaggaugggguaauggauguggauuauucggaaaaggaucccuaguaacaugugccaaauuuacauguaguaagaaaaugaccggaaaaucuauacagccagaaaauuuagaauaucguauaauguuaagcguacaugguagucaacacagcgguaugauaggguaugaaaccgacgaagacagagcaaaaguagaaguaacaccaaacucaccaagagcugaagccaccuuaggaggauucggaagucuuggauuagauugugaaccaagaacuggauuagauuucucagaccuuuauuauuuaacuaugaauaauaaacauugguuaguacauaaagaaugguuucacgacauaccuuuaccauggcaugcaggagcagauacaggaacgccacacuggaacaauaaagaagcauuaguagaauuuaaagaugcucacgcuaaaagacaaacaguuguaguauuagggucacaagaaggugcuguacauacugcauuagcaggagcacuagaagccgaaauggacggagcaaaaggcagauuauuuaguggacaucuuaaaugcagauuaaaaauggauaaacuaagacuaaaaggaguaagcuacagccuauguacugccgcauuuacauuuacaaaaguuccagcugaaacacuacaugggacaguaacaguagaaguccaauacgcaggaacugauggaccauguaaaauaccaguacaaauggcaguagacaugcaaacacuuacaccaguugggagguuaauaacagcuaaucccguaaucacugaaucaacagaaaauaguaaaaugauguuagaacuugacccaccauuuggagauucauacauuguaauuggaguaggugauaagaaaauaacacaucauuggcauagaucuggaucaacacuuggaaaagcauucagcacaacauugaaaggagcacaaagauuagcggcauugggggauacagcaugggauuucggaaguauaggaggaguauuuaauucaauuggucgagcaguccaccaaguauuuggaggagccuuuagaacauuauucggaggaaugucauggauuacacaaggauuaaugggagcccuauugcuuuggaugggaguuaaugcacgagaccguucgauagcucucgcauuucucgcuacuggcggaguucuaguauuuuuagcaacgaauguucaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10260 - RNA, 2284 nt, Artificial Sequence
  ZIKV (strain NatalRGN) prME-short variant mRNA Design 1 opt
gggagaaagcuuaccauggauuggacauggauucuauuucuuguagcagccgcaacaaggguacauagugucacaagaaggggaagugcauauuauauguaucuagacagaaaugaugcuggugaagccauaaguuuuccaacaacgcuaggaaugaauaaauguuacauccaaauaauggaucucggccauaugugugaugcgacaaugaguuaugaaugcccaaugcucgaugaagggguagaaccagaugauguagauuguugguguaauacaacaucaacuuggguaguuuauggaacaugucaucauaaaaaaggugaagcuagaagaucgaggagagcuguaacuuuaccuucucauagcacaagaaaauuacaaacaagaagccaaacuugguuagaaagcagagaauacacaaaacauuuaauuagaguagaaaauuggauauuucgaaauccaggauucgcauuagcugcagcagcaauagcauggcuucuaggcuccaguacaucucaaaaagugaucuauuuaguaaugauacuucuaaucgcaccagcauacaguaucagaugcaucgguguaucaaauagagauuuuguugaaggaaugucgggcggaacauggguagacgucguacucgagcauggcggcuguguaacaguaauggcacaagacaaaccaacaguugauauagaauuaguuacaacuacgguaaguaauauggcagaaguuaggagcuacuguuaugaagcaucaauaucagauauggcaucagauucaaggugcccaacgcaaggagaagcauauuuagauaaacaaagugacacucaauacguauguaaaagaacauuaguugauagaggauggggaaacggaugugguuuauuuggaaaaggaagcuuaguaacaugugcaaaauuugccuguucaaaaaaaaugacaggaaaaaguauacaaccagaaaaucuagaauaccguauaaugcuaucaguacauggaagucaacacagcgggaugauaguaaacgacacaggacacgaaacagaugaaaaucgugcaaaggucgaaauuaccccaaacagcccaagagcagaagcaacucuuggagguuucggaucauuaggacuagauugcgagccaagaaccgguuuagauuuuagcgauuuauacuauuuaacaaugaauaauaaacauugguuaguucauaaagaaugguuucaugauauaccacuaccauggcaugcaggugcggauacuggaacaccucauuggaacaauaaagaagcacuaguagaauucaaagacgcacaugcuaaaagacaaacaguugucguauuaggaagucaagaaggagccguacauacugcacuagcaggugcguuagaagccgagauggauggagcaaaaggccgacuuaguagcggucauuuaaaaugcagauuaaaaauggauaaauugagacugaaaggugugucauauucacuauguacugcagcauuuacauucacaaaaauaccugcagaaacacuacacggaacugucacaguagaaguacaauacgcagguacagaugguccauguaaaguaccagcucaaauggcuguagacaugcaaacauuaacaccaguuggaagacuaauaacagcaaaucccguaauaacugaaagcacagaaaauucaaaaaugauguuggaacuugauccaccauuuggcgauaguuacauaguaauaggaguuggagaaaaaaaaauaacacaucauuggcacagaaguggaagcaccuuaggaaaagcuuuuucaacaacauuaaaaggagcacaaagauuagcagcauuaggugacacagcaugggauuuuggcucaauuggugguguauucaauaguauagggagagcaguacaucaaguuuucggcggagcauuuagaaccuuauuuggcggaaugaguuggaucacucaaggacuaaugggagcacuauuacucuggauggguguaaaugcaagagauagaagcauagccuuagcauuucuugcuacaggaggaguauuaguauuccuagcuaccaauguacaugcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10261 - RNA, 2302 nt, Artificial Sequence
  ZIKV (strain ZikaSPH2015) prME-short variant mRNA Design 1 opt
gggagaaagcuuaccaugggcaaacguagugcaggaucgauaauguggcuagccucauuagcaguaguaauagcaugugccggagcaguaacgaggcgcggaucagcuuauuauauguaccuagacagaaaugaugcaggagaagcaauaucauucccuacaacacuuggaaugaauaaauguuauauacaaauaauggauuuaggacauaugugcgacgcaacuaugaguuacgaaugcccaaugcuugaugaaggcguagaaccagaugauguugauugcuggugcaacacaacgucaaccuggguaguguaugggacaugucaucacaagaaaggagaagcuagaagaaguagacgagcaguaacguuaccgagucauaguacgagaaaauuacaaacacgaucacaaacaugguuagaaagcagagaguacacaaaacauuuaaucagagucgaaaauuggauuuucaggaauccuggguuugcauuagcagcagcggcaauagcaugguuauuaggaucaaguacaucacaaaaaguaaucuaucuaguaaugauucuguuaaucgcucccgcauauuccauuagauguauaggaguaucaaacagagauuuuguggaaggaauguccggaggaacauggguagauauaguuuuggaacauggaggguguguaacagucauggcacaggauaaaccaacgguggauauagagcuaguaacaacaacaguaucaaauauggcagaaguaagaucuuauuguuaugaagcaucuauaagugauauggccagugacaguagauguccaacacaaggggaagcauaucuagacaaacaaagugauacacaauacguauguaaaagaacacuuguagauagaggauggggaaauggaugcggauuauucggaaaaggaucuuuaguaacaugcgcaaaauucgcaugcucaaagaaaaugacagguaaaaguauucaaccagaaaaucucgaauauagaauuauguuaaguguucauggaucacaacacagugguaugauaguaaacgauacagggcaugaaaccgaugaaaacagagcaaaaguagaaauaacaccuaauucaccuagagcagaagcuacucugggaggauucgggagucuuggacuagauugcgaaccaagaacaggucuugauuuuucugaucuauauuaucucacaaugaauaauaaacauugguuaguucacaaagaaugguuucacgacauaccguuaccauggcaugccggagcagauacgggaacuccacauuggaauaauaaagaagcucuuguagaauuuaaagaugcucaugcaaaaaggcaaacaguaguaguuuuaggcagccaagaaggagcaguacacacagcuuuagcuggagcauuagaagcagaaauggauggagcgaaaggaagacuaucgucaggucauuugaaaugcagacuuaaaauggacaaauuaagacuaaaaggaguuucauauucauuauguacugcagcauucacuuuuacaaaaauaccagcagaaacacuacauggcacaguaacuguagaaguacaauaugcuggaacagacggaccaugcaaagucccugcccaaauggcaguggauaugcaaacacuaacaccagugggaagacuaauaacagcaaauccaguaauaacagaaucaacagaaaacucaaaaaugauguuggaauuagauccaccuuuuggagacaguuauauuguaauaggcguaggagaaaagaaaauuacacaccauuggcauagaaguggaagcacacuuggaaaagccuuuagcacaacauuaaaaggagcucaaagauuagcugcacuaggagauacagcgugggauuuuggaaguauaggaggugucuuuaauaguaucggcagagcaguacaucaaguauucggaggagcauucagaacacuauuuggcggcaugucauggauuacacaagguuuaaugggagcucuauuauuauggauggguguaaacgcuagggaucggaguauugccuuagcuuuucuagcaacaggagguguguuaguauuuuuagcaacgaacgugcacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10262 - RNA, 2302 nt, Artificial Sequence
  ZIKV (isolate Z1106033) prME-short variant mRNA Design 1 opt
gggagaaagcuuaccaugggaaaacgaucagcaggaucuauaauguggcucgcaucauuagccguaguuauagcaugugcuggagcaguaacaagacgagguagcgcauacuauauguaucuggauagaaaugaugcgggagaagcuauaucguuuccaacaacacuagguaugaauaaauguuauauacaaauaauggauuuaggacauacaugugaugcaacaaugucauaugaauguccaaugcuagacgaaggaguugaaccagacgacguagacugcugguguaauacaacaaguacuuggguagucuauggaacgugccaucauaaaaaaggugaagcaagaaggucccgaagggcaguuaccuuacccagucauucaacuagaaaacuucagacaagaucacaaaccuggcuagaaucacgagaguauacaaaacauuuaauaagagucgaaaacuggauauuuagaaauccuggauucgcacuagccgcagcugcaauagcauggcuccuaggauccuccacaagucaaaaaguaauauauuuaguaaugauccuacucauugcaccagcauauucuauaagguguaucggaguaagcaaucgagacuuuguugagggaaugaguggcgguacauggguagauguuguacuagaacacggcggcugcguaacaguaauggcucaagauaaaccuacaguagauauagaauuaguaacuacuacaguaucuaacauggcagaaguaagaucuuacuguuaugaagccucaauaagcgauauggccucagauucaagauguccaacacaaggagaagcauacuuagauaaacaaucugauacacaauacguaugcaagagaacacuaguagauagaggaugggguaaugguuguggauuauucggaaaaggaagccuaguaacuugugcaaaauuugcauguaguaaaaaaaugacgggaaaaaguauccaaccugaaaauuuagaauauagaauaaugcuaucaguucauggcagucaacauagcggaaugauuguaaaugauacaggucaugaaaccgacgaaaacagagcaaaaguagaaauuaccccaaauaguccuagagcagaagccacuuuaggaggcuuuggaucccuaggucuugauugugaaccaagaacaggauuagauuuuucggacuuauauuaccuuacaaugaauaauaaacacuggcuaguucauaaagaaugguuccaugacauaccuuuaccuuggcaugcaggagcagacacuggcacaccacacuggaacaauaaagaagcgcucguagaauucaaagacgcccaugcaaaaagacaaacuguuguaguauugggaucacaagaaggcgcuguacauacagcauuagcaggagcucuugaagcagaaauggauggagcgaaaggaagacuaucaucggggcacuuaaaaugcagauuaaaaauggauaaguuacguuuaaaagggguuagcuacucucuuugcacagcagcauuuaccuuuacaaaaauaccagccgaaacacuacacgguaccguaacaguagaagugcaauaugcuggaacugaugguccauguaaaguaccugcacagauggcuguagauaugcaaacacuaacgccaguaggaagauuaauaacagcaaauccaguaauaacugaaucaacagaaaacucaaaaaugauguuggaacuagauccaccauuuggagauaguuauauaguaauaggaguaggagaaaaaaaaauaacucaccacuggcauagaucagguaguacguuagguaaagcauuuucgacaacauuaaaaggagcacagagauuagcugcacuuggagauacggcuugggauuucggaucaauaggaggaguauuuaauaguauuggaagagcgguacaucaaguuuuugguggagcauuuagaacccuauuuggaggaaugucuuggauuacacaaggacuuaugggagcauuauuauuauggaugggaguaaacgcucgagacagaucaaucgcauuagcauuuuuagcgacaggaggaguacuaguauuucucgcaacaaacguacacgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10263 - RNA, 2290 nt, Artificial Sequence
  ZIKV (strain MR 766) prME-short variant mRNA Design 1 opt
gggagaaagcuuaccaugggaaaaagaagugcaggaucaauaaugugguuagcaucacuggcgguaguuauagcaugcgcaggagcuauaacaaggaggggaucagcauacuauauguauuuagacaggagugaugcaggaaaagcaaucucauuugcaaccacacuagguguaaauaaaugucauguccaaauaauggaccuaggucauaugugugaugcuacaaugucguaugaaugcccaaugcuugacgaagguguggaaccagaugacguagauugcuggugcaacacaacaagcacauggguaguuuaugggacaugucaccauaagaaaggugaagcacgaagaucacggcgagcaguaacuuuaccaucacauucaacaaggaaacuacaaacaagaucacaaacaugguuagaaucaagagaguauacaaaacaucuaauuaaagucgaaaauuggauauuuagaaauccuggauuugcccuaguugcaguugcaauagcuuggcuucuuggaagcucaacaucccaaaaaguaauuuauuuaguaaugauacuacugaucgcuccugcauacaguauaagauguauaggaguaaguaauagagacuucguggaaggaauguccggagguacuuggguugauguaguauuagaacacgguggaugcguaacaguaauggcacaagauaaaccuacaguagacauagagcuaguaacaacaacuguaucgaauauggcugaaguuagauccuauuguuaugaagcaaguauaucggauauggcaucagacaguagauguccaacacaaggagaagcauacuuagauaaacaaagcgauacacaauauguauguaaaagaacauugguugauagaggauggggaaauggauguggauuauucggaaaaggaagucuaguaacuugugcaaaauucacguguucaaagaaaaugacaggaaaaucaauacagccggaaaaucuagaauauagaauaaugcuaucaguccauggaagccagcauucaggaaugauaggauacgaaacagaugaagauagagcaaaaguagaaguaacuccaaauucaccaagagcagaagcaacuuuaggcgguuuugguuccuuagguuuagacugcgaaccaagaacaggauuagauuuuucagauuuguacuaccuaacuaugaacaauaaacauuggcuaguucauaaagaaugguuucaugacauuccauuacccuggcaugcuggagcagacacaggaacuccacauuggaauaauaaagaagccuugguagaguuuaaagaugcacacgcaaaaaggcagacuguaguaguauuaggcucucaggaaggggcgguacacacagcauuagcaggagcauuagaagcagaaauggauggagcgaaggguagauuauuuaguggccauuuaaaguguagauuaaaaauggauaaauuaagauuaaaaggaguaucauauagucuuuguacagcagcuuucacauuuacuaaagugccagcagaaacauuacauggaacaguaacaguugaaguacaauaugcuggaacagauggaccauguaagauaccaguccagauggcaguagacaugcaaacucuaacaccagucgggagauuaauuacugcaaacccgguaauaacagaaagcacagaaaacagcaaaaugauguuagaauuagacccaccauuuggugacaguuauauaguaauagguguaggagacaagaaaauuacucaucacuggcaucgaaguggaagcacucuagguaaagcauucucuacaacacuaaaaggagcacaaaggcuagcagcacuaggugacacagcaugggacuuuggauccauaggaggaguuuuuaacucaauagguagagcugugcaucaaguauucggaggagcauuucguacuuuauucggaggaaugaguuggaucacacaaggauuaaugggagcacuauuauuauggaugggagucaaugcaagagauagaucaauagcacuagcauuuuuagcaacuggaggaguguuaguauuucuagcuacuaauguacacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10264 - RNA, 2302 nt, Artificial Sequence
  ZIKV (strain NatalRGN) prME-short variant mRNA Design 1 opt
gggagaaagcuuaccaugggaaaaagaucagcaggaaguauaaugugguuagcaagucuagcaguaguaauagcaugcgcaggagcuguaacgcgaaggggaucagcauauuauauguauuuagauagaaaugacgcaggagaagcaauaucauuucccacuacauuaggaaugaacaaauguuauauacaaauaauggacuuaggacauaugugugaugcaacaaugucauacgaauguccaauguuagacgaaggcguagaaccagaugauguagauugcuggugcaauacuacaaguacauggguagucuacggaacaugucaucauaagaaaggagaagccagaagaagcagacgagcaguuacacuaccaucacauaguacgagaaaauuacaaacaagaucacaaaccuggcuagaaaguagagaauauacaaaacauuuaauaagagucgaaaauuggauauuuagaaauccaggauuugcauuagcagcggccgcaauagcauggcuacuugguucuucaacaucacaaaaaguaauauauuuaguaaugauuuuacuaaucgcaccagcauacucaauaagauguauaggcguaagcaacagagauuuuguagaagggaugaguggaggaacuuggguagauguuguauuagaacacggcgguugcgucacaguaauggcacaagacaaaccaacaguagauauagaauugguaacaacaaccguaaguaauauggcagaaguaagaucauauuguuacgaagcaucaauaagugauauggcuucagauucaagauguccuacucaaggagaggcuuacuuagacaaacaaucagacacucaauacgucuguaaaagaacacucgucgauagaggaugggguaauggaugcggacuauuuggaaaaggaucauuaguaacaugugcaaaauucgcaugcaguaagaaaaugacaggaaaaagcauacaaccggaaaaucuugaauacagaauaaugcuuucaguucauggaucacaacauaguggaaugauagucaaugauacaggucaugaaaccgaugaaaauagagcaaagguagaaauaacaccgaacaguccaagagcagaagcaacacucggaggauuuggaucauuagguuuagauugugaaccaagaacgggacuagauuuuagcgauuuauauuaccuaacuaugaauaauaaacauugguuaguacauaaagaaugguuucaugauauaccuuuacccuggcaugcaggagcagauacuggaacuccucauuggaauaauaaagaagcauuaguagaauuuaaagacgcacacgcuaaaaggcaaacaguugugguuuuaggaagucaggaaggagcaguacacacagcauuagcgggagcauuagaagccgaaauggacggagcaaaaggccgauuaucaucaggacaucuuaaauguagacuaaaaauggauaaacuaagauuaaaaggaguuucuuauucauuguguacagcagcauuuaccuuuacaaaaauaccggcugaaacuuugcacggaacggugacaguagaaguacaauaugcagguacagacgguccuuguaaaguaccagcccagauggcaguagacaugcaaacacuaacgccaguagguagauuaaucacagcaaacccaguaauaacggaaagcacagaaaauucuaaaaugauguuagaauuagauccaccuuucggagacucauauauagucauaggagugggugagaaaaagauaacacaccauuggcacagaagcggaaguacauuaggaaaagcauucucaacaacacuaaaaggagcacaacgucuagcugcauugggugauacugcaugggauuuuggcagcauagguggaguauuuaauagcauugguagagcugugcaucaaguuuucggaggagcauuccgaacauuauuuggcggaaugucauggauaacacaaggauuaaugggagcacuauuauuauggaugggaguuaaugcaagagauaggaguaucgcacuagcauucuuagcaacaggaggaguauuaguguuuuuagcaacuaauguacacgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10265 - RNA, 2005 nt, Artificial Sequence
  ZIKV (strain ZikaSPH2015) ME variant mRNA Design 1 opt
gggagaaagcuuaccaugacaucaguuggaauaguaggccuacuuuuaacaacagcaauggcagcaguuacauuaccaagucauaguacaagaaaacuacagacaagaagccaaacaugguuagaauccagagaguacacuaaacauuuaaucaggguagaaaauuggauauuuagaaauccaggauuugcacuagcagcagccgcaauagcauggcuauuaggaucuucuacaucacaaaaaguaauuuauuuaguaaugauacuauuaauagcaccugcuuauaguauaagguguauuggaguuucaaaucgagacuuuguugaaggaauguccgguggaacauggguagacauaguauuagaacauggcgguuguguaacuguaauggcgcaagauaaaccaacuguagauauagagcuaguaaccaccacaguaaguaauauggcagaaguuagaaguuauuguuaugaagcgucaauaagugacauggcaagugauagccgauguccaacucaaggcgaagcauauuuagacaaacaaucagauacucaauauguuugcaaaagaacauuaguagauagagguuggggaaauggcuguggauuauuugguaaaggaucauuaguaacuugcgcaaaauuugcauguucaaaaaaaaugacaggaaaaucuauacaaccagaaaaucuagaauacagaauaaugcuaaguguacacggaucccaacauucaggaaugauuguaaaugauacuggacaugaaacagaugaaaauagagcaaaaguagaaauuacaccaaacucaccucgagcagaagcaacauuaggcgguuuuggaucuuuaggauuagauugcgaaccacguacagguuuagauuucucagaucucuauuaucucaccaugaauaauaaacauuggcuaguacauaaagaaugguuucaugauauuccauuaccauggcacgcgggggcagauacaggcacuccacauuggaacaauaaagaagcauuaguagaauuuaaagacgcccaugcuaaaagacaaacaguuguaguacuaggaagccaagaaggagccguacauacagcauuagcuggggcacuagaagcagaaauggauggagcaaaaggaagauuaaguucuggucaucuaaaauguagauuaaaaauggacaaacuacgauuaaaagguguuagcuauagcuuauguacagcagcauuuacauuuacaaaaauaccugcagaaacuuuacauggaacaguaacagucgaaguacaauacgcaggaacagauggcccauguaaaguuccagcacaaauggccguagacaugcagacauuaacacccguaggaagauuaauuacugcaaauccaguaauaacggaauccacagaaaacucaaaaaugauguuagagcuugacccaccguuuggagauaguuauauagugauaggaguaggagaaaaaaaaauaacucaccauuggcacagaagugguucuacaauaggaaaagcauucgaagcaacggucagaggugcaaaaagaauggcuguauuaggagacacagcaugggacuuuggcagcguaggaggagcacuaaacucauuaggaaaaggaauacaccaaauuuucggagcggcauucaaaagucuuuuuggaggaaugucuugguuuucacaaauauuaauaggaacacuacuaaugugguuaggacuaaauacaaaaaauggaucaauaucccugaugugccuagccuuaggaggcguacuaauauuuuuauccacugcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10266 - RNA, 2005 nt, Artificial Sequence
  ZIKV (isolate Z1106033) ME variant mRNA Design 1 opt
gggagaaagcuuaccaugacaagcguaggaauaguaggauuauuauuaacaacagcaauggcugcugucacccuaccaagucauaguacaagaaaacuacaaacuagaucacaaacauggcuagaaagucgagaauauaccaaacauuuaauaagaguggaaaauuggaucuuuagaaauccaggauuugcucuggcugcagcggcaauagcaugguuacuuggaucaaguacaucacaaaaaguaauauauuuaguuaugauauuacuuauagcaccagccuauaguauacguuguauaggcguuagcaauagagauuuugucgaaggaaugagcggaggaacauggguagacguaguacuagaacauggaggauguguaaccguaauggcacaagacaaaccuacgguggauauagaauuaguaacgacaacaguaucuaauauggcagagguacgaagcuacuguuaugaagcaaguauaucagauauggcaagugauagcagauguccaacacaaggagaggcauaccuagauaaacaaagugauacacaauaugugugcaaaagaacccuaguagaucgaggcuggggaaauggcugugguuuauuugguaagggaucauuaguaacaugugcaaaauuugcaugcucuaagaaaaugacaggaaaaucaauacaaccugaaaaucuugaauauagaauaauguugaguguacauggaucucaacauagcggaaugauugugaaugacacaggacacgagacagaugaaaauagagcuaaaguagaaauaacaccaaauucaccaagagcagaagcaacauuaggaggauucggaucguuagguuuagauugugaacccagaaccggauuagauuuuagcgauuuauauuaccuaacaaugaacaauaaacauugguuaguacauaaagaaugguuucaugauauucccuuaccuuggcaugcuggagcagauacaggaacaccacacuggaacaauaaagaagcauuaguagaauuuaaagaugcacacgcaaaaagacaaacugugguaguacuaggaagucaagaaggugcaguacacacagcauuagcaggagcauuagaagcagaaauggacggagcuaaaggaagauuaucuucaggacaccuaaaguguagauuaaaaauggacaaacugagacuaaaagguguaaguuauaguuuauguaccgcagcuuuuacauuuacaaaaauaccagcagaaacacuacacggaacaguaacggucgaagugcaauaugcaggaacagauggaccaugcaaagugccagcacaaauggcgguagacaugcaaacauuaacaccaguaggaagauuaauuacugcaaauccaguuauaaccgaaagcacagaaaacucaaaaaugauguuagaacuagauccaccuuuuggagauaguuauauaguaauaggaguaggugaaaagaaaaucacacaccauuggcauagaaguggcucaacaauaggaaaagcauucgaagcaacaguaagaggggcaaaaagaauggcuguacuaggagauacagcaugggauuuuggaucagucggaggagcauuaaacagcuugggaaaaggaauacaucaaauauuuggagcugcauuuaagaguuuauucggcggaaugaguugguuuagucaaauauuaauaggaacuuuacucaugugguuaggguuaaaugccaaaaauggcucgauuagucuaauguguuuagcuuuaggaggaguauuaauauuucuaagcacagcggucucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10267 - RNA, 1993 nt, Artificial Sequence
  ZIKV (strain MR 766) ME variant mRNA Design 1 opt
gggagaaagcuuaccaugacaaguauaggaauaauaggacuacuauuaacaacagccauggcagcaguaacacuaccuucacacucgaccaggaaacuacaaacccgaagucaaaccugguuagaaaguagagaauacacuaaacaucuaauaaaaguugaaaauuggauauuuagaaauccaggauuugcuuugguugcaguugcuauagcauggcuauuaggaagcagcacaucucaaaaaguuauuuaucuaguuaugauacucuuaauagcuccugcauauaguauacgcuguauaggaguaucaaauagagauuuuguagaaggaaugucaggaggcacauggguagauguuguacuagaacacgguggauguguaacaguaauggcacaagauaaaccaacgguagacauagaauuaguaacaacaaccguaaguaauauggcagaaguacgaucauacugcuaugaagcaucaauaagcgacauggcaagugauucuagaugcccaacacaaggugaagcauaucuagauaaacaaucugacacgcaguauguauguaaacgcacgcuaguagauagaggaugggguaacgguuguggucuauuugguaaaggaucucuuguaacaugcgcaaaauucacauguucuaagaaaaugacaggaaaaagcauucagccagaaaaucuagaauacagaauaaugcuaucuguucauggaucucaacauuccgguaugauaggauaugaaacugaugaagauagagcuaaaguagaaguaacaccaaauaguccaagagcugaagcaacacuaggaggcuucgguaguuuaggguuagauugugaaccgagaacaggacuugacuuuagugaccuauauuaucuuacaaugaacaauaaacauugguuaguccauaaagaaugguuccacgauauaccacuaccauggcaugcuggugcagauacaggaacaccacacuggaauaauaaagaagcucuaguagaguucaaagaugcacaugcaaaaagacaaacaguaguaguacuaggaagucaagaaggggcaguacauacagcauuagcaggagcauuagaagcagaaauggacggagcaaaaggacgucucuucuccggacaccuaaaaugcaggcuaaaaauggacaaauuaagguuaaaaggaguaucuuauucacuuuguacagccgcauucacauuuacaaaaguaccagcagaaacacuacauggaacuguaacaguugaaguucaauaugcuggaacagauggaccauguaaaauaccuguacaaauggcaguagauaugcaaacuuuaacaccaguagguagauuaauaacagcaaacccuguuauaacagaaaguacagaaaacagcaaaaugaugcuagaacuagacccuccauucggagacucuuacauaguaauuggaguaggagacaagaaaauaacacaucauuggcaccgaucuggcucaacaauaggaaaagcauuugaagcaacaguaagaggagcaaaaagaauggcaguauuaggagauacugccugggauuuuggaucaguaggaggaguauucaauagcuuaggcaaaggcauacaucaaauauuuggugcugcauucaaaaguuuauuugggggaaugucaugguuuucacaaauucuaauaggaacacuauuaguauggcuaggauuaaacacgaaaaauggaagcauuagucuaacaugucuagcucuagguggaguaaugauauuccuaucaacagcaguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10268 - RNA, 2005 nt, Artificial Sequence
  ZIKV (strain NatalRGN) ME variant mRNA Design 1 opt
gggagaaagcuuaccaugacaucaguaggaauagucggauuauuauuaacaacagcaauggccgcaguaacauuaccaagccauaguacuagaaaauuacaaacacgaagccaaacaugguuggaaucaagagaauacacaaaacaucuuauaagaguggaaaauuggauauucagaaauccaggauuugcacuagcagcagcagcuauagcauggcuucuaggcaguaguacaucacaaaaagucauuuauuuaguaaugauauuacuuauagcuccagcauauucuauucguuguauaggaguaucaaacagagacuuuguugaaggaaugaguggaggaacuuggguagauguaguuuuagaacaugguggauguguaacaguaauggcacaagauaaaccuacaguagauauagagcuaguuacaacaacgguaucaaauauggccgaaguaaggaguuauuguuaugaagcaucaauaucagauauggcaucagauaguagauguccaacacagggcgaagccuaucuagauaaacaaucagacacacaauauguauguaaaaggacacugguggauagaggauggggcaacggauguggcuuauuuggaaaagguaguuuagucacaugugcaaaauuugcauguucuaagaaaaugacagguaaaucuauccaaccagaaaaucuagaauauagaauaaugcuuagcguucauggaagucaacacagugguaugauugugaaugauacuggacaugaaacagacgaaaauagagcaaaaguagaaauaacaccaaacucacccagagcugaagcaacacuaggaggauucggaucacuuggacuagauugugaaccuagaacuggacuugauuucagugauuuauacuacuuaacuaugaauaauaaacauugguuaguacauaaagaaugguuccacgacauuccacuaccuuggcaugcuggugcagauacaggaacgccacauuggaauaauaaagaagcacucguagaguucaaagaugcacaugcaaaacgacaaacgguaguuguauuaggaagucaagaaggcgcaguccauacagcauuagcuggagcacuagaagcugaaauggauggagcaaaagguagauuaaguuccggacaccuaaaauguagacuaaaaauggauaaauuaagacugaaagguguaagcuauagucugugcaccgcugcauuuacauucacaaaaauaccugcugaaacauuacauggaacaguaacaguugaaguacaauaugcaggaacagacggaccuugcaaaguacccgcacagauggcuguagacaugcaaacauuaaccccagugggaagacuaauaacagcaaauccaguaauaacagaaagcacugaaaauucaaaaaugauguuagaacucgauccaccauuuggggauagcuauauaguaauaggaguaggcgaaaagaaaauaacacaccacuggcauagaagugguaguaccauuggaaaagcauuugaagcuacagucagaggagcaaaaagaauggcaguacuuggcgauacagcuugggauuuugguucuguaggcggagcuuuaaacaguuuaggaaaaggaauacaucaaaucuuuggagcagccuuuaaaaguuuauuuggaggaaugaguugguuuucccaaauuuuaauaggaaccuuauuaauguggcuagguuuaaauacgaaaaaugggagcaucagcuuaaugugucuagcacuuggugggguauuaauauuucuaagcacagcgguaucugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10269 - RNA, 2032 nt, Artificial Sequence
  ZIKV (strain ZikaSPH2015) ME variant mRNA Design 1 opt
gggagaaagcuuaccauggccauaagcggaguaccaguauuaggauucuucauaaucgcaguacuaaugagugcacaagaaaguugggcagcagugacauuaccaagucacaguacaagaaaauuacaaacacguagucaaacaugguuagaaagucgagaauauacaaaacaucuaauacguguagaaaacuggauauuuagaaauccaggauuugcuuuggcagcagcugccauagcauggcuucuaggaagcucaacaucacaaaaaguuauauaucuagucaugauucuucuaaucgccccugcauauucaauaagauguauaggagucucaaacagagauuucguagaaggaaugucaggaggaacauggguagacauaguccuugaacacggaggauguguaacuguuauggcccaagauaaaccuacuguagauauagaauuggucacaacuacaguaagcaacauggcagaaguaagaucauauuguuaugaagcuagcauaucagauauggcaucagauucaagaugcccaacacaaggugaagcauaucuagauaaacaaucagauacacaauacguauguaaacgaacauuaguagauagaggauggggaaauggauguggacuuuuuggaaaaggaucauuaguaacaugcgccaaauuugcguguucaaagaaaaugacuggaaaaucaauacaaccggaaaaccuagaauauagaauaauguuaaguguucauggaucacaacauucagguaugauaguuaaugauacaggacaugaaacagaugaaaacagagcaaaaguagaaauaacaccaaauucaccaagagcagaagcaacauuaggcgguuucggaaguuuaggacuugauugugaaccuagaacagguuuagauuuuucagaccuauauuauuugacaaugaauaacaaacacugguuaguacacaaagaaugguuccaugauauaccacuaccauggcaugcuggugcggauacaggaacuccccauuggaauaauaaagaagcguuaguagaauuuaaagacgcacacgcaaaaagacaaacuguaguaguauugggaucucaagaaggagcaguacacacugcauuagcaggagcacuagaagcagaaauggauggagcuaaaggcagacuuagcaguggacauuuaaaaugucguuuaaaaauggacaaauuaagauuaaaagggguauccuacucccuaugcacagcugcuuuuacuuucacaaaaauuccugcagaaacacuucauggaaccguaacaguagaaguacaauacgcgggaacagaugggcccugcaaaguacccgcacaaauggcaguagauaugcaaacauuaacaccuguaggcagauugauaacugcuaauccaguaauaacagaaucaacagaaaauaguaaaaugaugcuagaauuagacccaccauuuggcgauaguuauauagucauuggaguuggggagaagaaaauaacucaucacuggcacagaucaggaaguacuauaggaaaagcauucgaagcaacagugagaggagcaaaaagaauggcaguauuaggugauacagcuugggauuuuggaucaguaggaggagcacuaaacucucuagguaaaggaauccaucaaauuuuuggugcagccuuuaaaucauuauuuggaggaaugucaugguucagucaaauauuaauagguacauuauuaauguggcugggacuaaauacuaaaaacgguaguauaagccuaaugugucuagcacucggugguguacuaauauucuuaaguacagcagucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10270 - RNA, 2032 nt, Artificial Sequence
  ZIKV (isolate Z1106033) ME variant mRNA Design 1 opt
gggagaaagcuuaccauggcgauaaguggaguaccaguguuaggauuuuuuauaauagcaguacuaaugucugcucaagaaucaugggcagcagucacauuaccaucacacucaacuaggaaauuacagacccgaucgcaaaccuggcuggaaucaagagaauauacaaaacacuuaauaagaguagaaaauuggauauuuagaaaucccggauucgcacuagcagcggcugcaauugcuugguuacuuggauccaguacaucccaaaaaguaauauauuuaguaaugauacuucuuaucgcaccagccuauaguauuagauguauuggaguaucaaauagagauuuuguagaaggaaugucaggagguacuuggguugaugugguacuagaacacggcggaugugucacaguaauggcacaagauaaacccacaguagauauagaauuaguaacgacaacagugucaaauauggcagaaguaagaucauauugcuacgaagcaaguauaagugacauggcaucagauucacgauguccaacacaaggagaagcauauuuagauaaacaaucagacacacaauauguauguaaaagaacauuagucgauagggguuggggaaacggaugcggcuuauuuggaaaaggauccuuaguaaccugugcaaaauucgcauguucgaaaaagaugacaggaaaaucuauacaaccagaaaauuuagaauauagaauaaugcuaucaguacacggaucucaacauucagguaugauaguaaaugauacuggacaugaaacagacgagaacagagcaaaaguagaaauaacuccaaauagcccacgugcggaggccacacuaggaggauuuggaagccuggggcuagacugugaaccuagaacaggacuagauuucucagaccuauauuauuuaacaaugaauaacaaacauugguuaguccacaaagaaugguuucaugauaucccacuaccauggcacgcaggugcagauacggguacaccacauuggaauaacaaagaagcauuagucgaauuuaaagaugcccaugcaaaaagacaaacaguaguaguacuagguucacaagaaggagcugugcauacagcacuagcuggugcauuagaagcagaaauggauggagcaaaaggaagauuaucaagcggacauuugaaaugucgacuaaaaauggauaaacuuaggcuuaaagguguaagcuacucuuuauguaccgcagcauucacguucacaaaaauaccagccgaaacauuacacgguacuguaacaguagaaguacaauacgcagguacagauggaccauguaaaguaccagcucaaauggcaguagacaugcaaacuuuaacaccaguagggagauuaauaacagcgaauccaguaauuacagaauccacagaaaacaguaaaaugaugcuagaauuagauccacccuuuggagacucauauaucguaauagguguaggugaaaaaaaaauaacacaucacuggcaucgaucuggaucaaccauaggaaaagcauuugaagcuacaguaagaggagcgaaaaggauggcaguuuuaggagacacugcaugggauuuugguaguguaggaggagcauuaaauucauuggguaaaggcauacaucaaauauucggagcagcauuuaaaagcuuauuuggaggaaugaguugguuuucacaaauacuaauaggaacuuuacuuaugugguuaggucuaaaugcuaaaaauggcucaauaucacuaauguguuuagcacuagguggaguacuaauauuuuuaaguacagcuguaucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10271 - RNA, 2020 nt, Artificial Sequence
  ZIKV (strain MR 766) ME variant mRNA Design 1 opt
gggagaaagcuuaccauggcaauaucagguguaccagucuuagguuucuuuauaauagcaguauuaaugucagcacaagaaagcugggccgcaguaacucuacccagucacucgacaaggaaacuacaaaccagaucacaaacaugguuagaaaguagagaauauacaaaacaccuuauuaaaguagaaaauuggauauuuagaaauccuggguucgcguuagucgcaguagcaauagcauggcuauuaggaagcagcacaagucaaaaaguaauauaccuaguaaugauauuacuaaucgcgccagcauauaguauacguuguauaggaguuucaaacagagacuuuguagaaggaaugucaggagguacauggguagaugucguauuagaacauggaggaugugucacaguuauggcucaagauaaaccaacaguagauaucgaauuaguaacaacuacugucaguaauauggccgagguuagaucauacuguuacgaagcaucaauaucagauauggcaagugauaguagaugcccaacacaaggagaagcauauuuagacaaacaaucagauacucaauacguauguaaacgaacacuaguagacagagguuggggaaacggauguggauuauuuggaaaaggaaguuuaguaacaugugcaaaauuuacuugcucaaaaaaaaugacuggaaaaucaauucaaccggaaaaucuagaauaucgaauaaugcuaaguguacauggaagccaacauucaggaaugauuggcuaugaaacugaugaagacagagcuaaaguugaagugacaccaaacucaccuagagcagaagcaacauuaggagguuucgguucauuaggauuagauugcgaaccacgaacagguuuagauuucagugaucuauauuauuuaacaaugaacaauaaacauuggcuaguacauaaagaaugguuccaugauauaccacucccauggcaugcgggugcagacacaggcacuccacacuggaacaauaaagaagcuuuaguagaauuuaaagaugcacacgcaaaaagacagacaguaguuguacuaggaucacaagaaggagcaguacacaccgcacuugcaggcgcauuagaagcggaaauggacggagccaaagguagauuauuuaguggacauuuaaaauguagauuaaaaauggauaaauuaagacuaaaaggaguaagcuacucauuaugcacagcagccuuuacauuuacaaaaguacccgcugaaacauugcacggaacaguuacaguugaaguucaauacgcaggaacagauggaccauguaaaauaccaguacaaauggcagucgacaugcaaacauuaacaccaguaggucgacuaauaacagcaaaccccguuauaaccgaaucuacugaaaacucgaaaaugaugcuagaacuagacccaccguuuggagauucauauauaguaauaggcguaggagauaaaaaaauaacacaucauuggcacagauccggaagcacaauaggaaaagcauuugaagcuacaguaagaggagcuaaaagaauggcaguauuaggagauacagcaugggacuuuggaaguguaggagguguauuuaacaguuuaggaaaaggaauacaucaaauauuuggcgcagccuuuaaaagccuauucggaggaaugagcugguuuucacaaauucuaaucggaacucuacuaguguggcuaggacuuaauacaaaaaaugguagcauaaguuuaacaugucuagcauuaggagguguuaugauauuucuaucaacagcgguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10272 - RNA, 2032 nt, Artificial Sequence
  ZIKV (strain NatalRGN) ME variant mRNA Design 1 opt
gggagaaagcuuaccauggcaauuucuggaguuccaguauuagguuuuuuuauuauagcgguacuaaugagugcacaagaaagcugggcagcaguaacauuaccuagucauaguacuagaaaacuacaaacaagaucacaaacaugguuagaaucgcgagaauauaccaaacauuuaauaagaguagagaacuggauuuucagaaauccaggcuucgcccuagcagcagcagcaauagcaugguuauuaggaaguucaacaucacaaaaaguuauauaucuagucaugauauuauugauagcgcccgcauauucaauacgauguaucggaguaucaaauagagauuuuguagaaggaaugucuggaggaacuuggguagacgucguacuagaacacgggggauguguaacaguaauggcucaagauaaaccuacaguagauauagaauuaguaacgacaacaguaagcaacauggcagaagucagauccuauuguuaugaagccaguauuagcgacauggcgagcgauagcagauguccaacacaaggggaagcuuauuuagauaaacaaucagacacacaauacguauguaaaagaacauuaguagauagagguuggggaaaugguuguggacuuuuuggaaaaggaaguuuaguaacaugugcaaaauuugcaugcucuaaaaaaaugacaggcaaaucaauacaaccagagaaccucgaauauagaauaauguuaagcguacauggaagucaacauagcgguaugauaguaaaugacaccggacacgaaacagacgaaaauagagcaaaaguagaaauaacgccaaauaguccgcgcgcagaagcaacauuaggaggauucggaucacuaggauuagacugugaaccaagaacaggacuugauuuuucugaucuauacuaucuuacaaugaauaauaaacauugguuaguucauaaagaaugguuccaugauauuccuuuaccauggcacgcaggugcagauacaggaacaccacauuggaauaauaaagaagcauuaguagaauucaaagaugcucaugcuaaacgucaaacuguaguuguauuaggaagccaagaaggagcaguucauacugcauuagcaggagcauuagaagcugaaauggauggugcaaaagguagauugaguaguggacauuuaaaauguagacuaaaaauggacaaauuacgacuaaaaggaguuucauauagucuauguacugcugcauuuacauucacaaaaauaccagcugaaacauuacacggaaccguuacaguugaaguacaauacgcaggcacagauggaccaugcaaaguuccagcacaaauggcaguagacaugcaaacauuaacaccaguaggaagacuaauuacagcaaauccuguaauaacagaaucaacugaaaauagcaaaaugauguuagaauuagauccaccauuuggagauucauauauugugauaggaguaggagaaaaaaaaauuacacaccacuggcauagaucugggucaacaauagguaaagcauucgaagcuacuguaagaggagcaaaaagaauggcaguacuuggagauaccgccugggauuucgguaguguaggaggagcacuaaacucacuuggaaaaggcauacaucaaauauuuggagcagcauuuaaaucacuauuugguggaaugucaugguuuucacagaucuuaauagguacacuacuaauguggcuaggacuuaauacaaaaaauggaucaauaucauuaauguguuuagcauuaggaggaguuuuaauuuuuuuaagcacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10273 - RNA, 2011 nt, Artificial Sequence
  ZIKV (strain ZikaSPH2015) ME variant mRNA Design 1 opt
gggagaaagcuuaccauggauuggacauggauauuauucuuaguugcagcugcaacaagaguacauagugcaguaacauugccgucacacucaacaaggaaauuacaaacaagaagccaaacaugguuagaaagccgagaauacacaaaacauuuaauuagaguagaaaacuggauauuuagaaauccaggauuugcucuagcggcagcagcaauagcaugguuacuuggaucaucaacaagccagaaaguaauauacuuaguaaugauacuucuuauagcuccagcauacucaauacgauguauuggaguaagcaauagagauuuugucgaaggaaugucaggaggaacaugggucgacaucguauuagaacaugguggauguguuacaguaauggcacaagauaaaccuacuguagauauagaacucguaacuacaacuguaucaaacauggcagaaguaagaucauacugcuaugaagcaucaauaagugauauggcaucggauaguagauguccuacacaaggagaagcauauuuagauaaacaaucagauacacaauacguauguaaacguacuuuaguagauagagguuggggaaauggaugcggauuauuuggaaaagguaguuuaguaacaugugcaaaauuugcuuguucaaagaaaaugacagguaaaaguauacaaccagaaaauuuggaauauagaauaauguuaucuguacauggaagccaacauaguggaaugauuguaaaugauacaggacaugagaccgaugaaaauagagcaaaaguagaaauaacuccaaauucaccacgagcagaagcgacauuaggaggauucgguucauuagguuuagauugugaaccaagaacagggcuagauuuuucugaucuauauuaucuaacuaugaacaauaaacauuggcuaguacauaaagagugguuucaugacauaccauuaccauggcaugcuggagcagauacaggaacaccacauuggaacaauaaagaggcuuugguugaauuuaaagacgcccacgcaaaaagacagacaguagucguuuuaggcagucaagaaggagcaguucacacagcauuagcuggagcauuagaagccgaaauggacggagcaaaaggucgauuaucaaguggacaccuaaaauguagauuaaaaauggacaaacuacgacuuaaagggguuucauauucacuauguacagcagccuuuaccuuuacaaaaauaccagcagaaacuuuacaugguacaguaacagucgaaguccaauaugcagguacagauggcccauguaaagucccggcacaaauggcaguagauaugcagacacuaaccccaguaggaagacuuauaacagcaaauccaguuauaacagaaucuacugaaaauucaaaaaugauguuagaguuagauccuccauuuggagauagcuauaucguaauaggagucggagaaaagaaaauaacacaucauuggcauagaaguggaaguaccauaggaaaagcauuugaagcaacaguaagaggagccaaaagaauggcaguacuuggagauacggcaugggauuuuggcagcguaggaggugcauugaauaguuuaggaaaaggaauacaucaaaucuuuggugccgcauucaaauccuuauuuggaggaaugagcugguuuucacaaauacuaaucggaacauuacuaaugugguuaggauuaaauacuaaaaauggaagcauaaguuuaaugugccuggcacuaggaggaguacuaauauuuuuaaguacagcagugagcgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10274 - RNA, 2011 nt, Artificial Sequence
  ZIKV (isolate Z1106033) ME variant mRNA Design 1 opt
gggagaaagcuuaccauggauuggacauggauauuauucuuaguagcugcagcaacccgaguacacucagcagucacauuacccagucauagcacaaggaaauuacaaaccagaucacaaacuugguuagaaucaagagaauacacaaaacaucucauaagaguugaaaacuggauauuuagaaaccccggcuuugcucuagcagcagcagcaauugcauggcuacuaggaagcucuacaucacaaaagguaauauauuuaguaaugauacuauuaauagcaccagcuuacaguauuagauguauaggaguuucgaauagagacuuuguagaaggaaugucaggagguacauggguagauguaguacuagaacauggcggaugugugacaguuauggcacaagauaaaccaaccguagauauagaauuagugacgacaacaguaucaaauauggccgaaguaagaucuuauuguuaugaagcauccauuucugacauggccucagauaguagaugccccacucaaggagaagcauacuuagauaaacagucagacacucaauacguuuguaaaagaacucuaguagauagagguugggguaauggauguggauuauuuggaaaaggaagccuaguaacaugcgcaaaauuugcauguaguaaaaagaugacuggaaaaucaauacaaccagaaaaccuugaauaucgaauuauguugucaguccacggaagucaacauaguggaaugauaguaaaugacacaggacacgaaacagacgaaaauagagcuaaaguagaaauaacaccaaauucuccgagagcugaagcaacacuuggaggauuugguagcuuagguuuagacugugaaccaaggacuggauuggacuuuucagaucuauauuauuuaacaaugaauaauaaacacuggcuaguacacaaagaaugguuucacgauauuccauuaccauggcaugcaggagcugacacagguacaccacauuggaauaauaaagaagcauuaguagaguucaaagaugcacacgcgaaaagacaaacaguaguagugcuagguucacaagaaggagcaguacauaccgcauuagcaggagcauuagaagcagaaauggauggagcaaaagggagacuaucaaguggacauuuaaaauguagauugaagauggauaaauuaagauugaaagggguaucuuacaguuuauguacugcagcuuucacauuuacaaaaauaccagcagaaacacuacauggaacaguaacaguugaaguacaauacgcaggaacagauggacccugcaaaguuccagcucaaauggcaguagauaugcaaacucuaacgccaguaggacgguuaauaacagccaauccagugauuacagaaucgacagaaaacucaaaaaugaugcucgaauuagauccacccuuuggagauucauauauuguuauaggaguaggagaaaagaaaauaacacaucauuggcauaggagcggcucaacuauaggaaaagcauucgaagcaacaguaagaggagcuaaacgaauggcaguauuaggagauacagcuugggacuucggaagcguuggaggagcccuaaauaguuuaggaaaaggaauacaucaaauauucggagcagcauuuaaaucauuauuuggaggaaugaguugguucucacaaauucuuauuggaacccuauuaauguggcuaggcuugaaugcuaaaaauggaaguauaagucucaugugcuuagcacuaggagggguauuaauauuuuuauccaccgcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10275 - RNA, 1999 nt, Artificial Sequence
  ZIKV (strain MR 766) ME variant mRNA Design 1 opt
gggagaaagcuuaccauggauuggacauggauauuauuuuuagucgcagcagcaacuagaguacauucugcaguuacuuuaccaagucauucaacaaggaaacuacaaacaagaucacaaacauggcuagaaucaagagaauacacuaaacaucuaauaaaaguagaaaauuggauauuuagaaaucccggcuuugcacucguggcaguagcaauagcaugguuguuagggagcucuaccagucaaaaaguuauuuaucuuguaaugauacuacuaauagcaccagcauauagcauaagauguauaggaguuagcaacagagacuuuguggaaggaaugucaggaggaacauggguagaugucguacuagaacauggcggauguguaacaguaauggcacaagauaaaccaacaguagauauagaacuaguaacaacaacuguaucuaauauggcagaaguaagaucauacuguuaugaagcaagcauuucugauauggcaucagauagcagaugcccaacacaaggagaagcauaucuagauaaacaaagugauacacaauacguaugcaaaagaacauuaguugacagaggaugggggaaugguugcggucuguuuggaaaaggaaguuuaguuacaugugcuaaauuuacaugcaguaaaaaaaugacuggaaaaagcauucaaccagaaaauuuagaauaccgaauaauguuaagcguacauggaagccaacacucaggaaugauaggauaugaaacagaugaagauagagcuaaaguagaagucacaccgaauucaccaagagcugaagcaacucuaggagguuuugguucacuugguuuagauugugaaccaagaacaggacuagacuucucagauuuguauuaccuaacaaugaauaauaaacauuggcuaguucauaaagaaugguuucacgacauaccauugccuuggcacgcaggagccgauacuggaacaccacauuggaauaauaaagaagcacucguagaauuuaaagaugcacaugccaaaagacaaacuguagucguacuaggaagucaagaaggggccguacauacugcauuagcaggcgcacuagaagcugaaauggauggcgcaaaagguagacuauucagcggacaccuaaaaugucgauuaaaaauggauaaauuaagauuaaagggaguaagcuauucuuuauguacagccgcuuuuacauucacuaaaguaccagcagaaacauuacacgguacaguaaccguagaaguccaauacgcaggaacagauggaccaugcaaaauuccaguacaaauggcaguagauaugcaaacguuaacaccaguaggucgauuaauuacagcaaauccaguaaucacagaaucaacagaaaauucgaaaaugaugcucgaacuagacccuccauucggagauaguuauauaguaaucggaguaggagauaaaaaaauaacacaccacuggcauagaaguggcucaacaauagggaaagcauuugaagcaacaguaagaggagcaaaaagaauggcaguuuuaggugacacugcaugggacuuugguaguguaggagguguauuuaauagcuuaggaaaaggaauccaucaaauauuuggagcagcauucaaaucauuauucggugguaugucaugguucucacaaauucuaauagguacacuucuuguuugguuaggucuaaauacaaaaaauggaucaauuucucuaacauguuuagcuuuaggaggggucaugaucuucuuaucuacggcaguaucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10276 - RNA, 2011 nt, Artificial Sequence
  ZIKV (strain NatalRGN) ME variant mRNA Design 1 opt
gggagaaagcuuaccauggacuggacauggauucuauuucucguagcagcagcaacaagaguucauucagcaguaacauuaccaucacauucaacaagaaaacuacaaacaagaagucaaacauggcuagaaucgagagaauauacaaagcauuuaaucagaguagaaaacuggauauuuagaaacccuggauuugcauuggccgcugcugcaauagcaugguuacuuggaagcagcacaagucaaaaaguaauauaucuaguaaugauacuauuaauagccccagcauauucaauuagauguauaggagucucaaauagggauuucguagaaggaaugaguggaggaacauggguagacguaguacuagaacacggugggugcguaacaguaauggcacaagacaaacccacaguagauauagaauuagugacaacuacaguuaguaacauggcagaaguuagaaguuauuguuacgaagcaagcauaagugauauggcaagcgauucucgauguccgacucagggagaagcauaucuagacaaacaaucugauacacaauauguguguaaacgaacucuagucgauagaggguggggaaauggauguggacucuuuggaaaaggaagucuaguaacgugcgcuaaauuugccuguaguaagaaaaugacgggaaaauccauacaacccgaaaacuuagaauauagaauaauguuaagugugcauggaagucaacauaguggaaugauaguaaacgauacaggacacgaaacagaugaaaauagagcaaaaguagaaauaacacccaauagccccagagcagaagcaacacuaggagguuuuggaucauuaggacucgauugugaaccuagaacuggguuagauuuuucagauuuauauuauuuaacaaugaauaauaaacauugguuaguucauaaagaaugguuucaugauauaccuuuaccauggcaugcuggggcagacacaggaacaccacauuggaauaacaaagaagcauuaguagaauuuaaagacgcacaugcuaaaagacaaacugugguagugcuagggagucaagaaggggcaguacauacagcauuagccggagcuuuagaagcagaaauggauggagcaaaaggaagauuauccagcggacaucuaaaauguagauuaaaaauggauaaauuacguuuaaaaggugugagcuacucacuuuguacagcugcauuuacauucacaaaaauuccagcagaaacccuacacggaacagucacagucgaaguacaauacgcaggaacagacggaccuugcaaaguacccgcucaaauggcagucgauaugcaaacauuaacaccuguagguagacuaauuacagcaaauccaguaauaacagaaucaacagaaaauaguaaaaugaugcucgaauuagauccaccauuuggugauucauauauaguuauaggaguaggagagaaaaagauuacacaucauuggcauagaaguggaaguacaauaggaaaagcauuugaagcaacaguaagaggagcaaaacgaauggcaguauuaggagauacagcuugggacuuuggaaguguuggaggugcacuaaauaguuuaggaaaaggaauacaucaaauauuuggagcagcauuuaaaucauuauuuggugguaugucgugguuuucccaaaucuuaauaggaacuuuauuaauguggcuaggauuaaauacgaaaaauggaucaauaucacucaugugucuagcauuaggaggaguuuuaaucuuuuuaucaaccgcaguuucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10277 - RNA, 2029 nt, Artificial Sequence
  ZIKV (strain ZikaSPH2015) ME variant mRNA Design 1 opt
gggagaaagcuuaccaugggaaaaagguccgcaggaaguauaaugugguuagcuagcuuagcaguagugauagcaugugcaggagcugcaguaacauuaccaucacauuccacaagaaaacuacaaacaagaucucaaacaugguuagaaucaagagaauacacaaaacaccuaauacgaguagaaaacuggauauuuagaaauccuggauucgcacuagccgcagcagcaauugccugguuauuaggaaguaguacaagccaaaaaguaauauauuuaguaaugauauuauuaauugcaccagcauauaguauaagauguauaggaguaaguaauagagauuuuguagaaggaaugaguggagguacauggguagauauaguauuagaacacggaggauguguaacaguuauggcucaagauaaaccuacaguugauauugaauuaguaaccacuacaguaucaaauauggcugaaguaagaaguuauuguuaugaagcaaguauuagcgauauggcgagugauagcagaugucccacacaaggugaagcauacuuagauaaacaaagugacacacaauauguaugcaaaagaacucuaguagauagaggauggggaaacgguugcggauuauuuggcaaagguagcuuagucacaugugcaaaauuugccugcaguaagaaaaugacaggaaaaaguauacaaccagaaaauuuagaauauagaauaaugcuuagcgugcacggaucacaacauucaggaaugauagugaaugauacaggacaugaaacagacgaaaauagggcaaaaguugaaauuacgccaaauagucccagggcagaagcaaccuugggaggauuuggcaguuuaggacuagauugugaaccaagaaccggauuagauuucucugaucuauauuauuuaacgaugaauaauaaacacugguuaguacacaaagaaugguuucaugauauaccauuaccguggcacgcaggagcagauacaggaacaccucauuggaauaauaaagaagcucuaguagaauuuaaagacgcccacgcgaaaagacaaacagucguaguauuagguagccaggaaggagccguucacacagcauuagccggugcuuuagaagcagaaauggauggagcaaaagguagacuaagcaguggacacuuaaaauguagguuaaaaauggacaaauuaagacuaaaagguguaucauauaguuuauguacagcggcauuuacguucacaaaaauucccgcagaaacauuacacggaacaguaacaguagaaguacaauaugcaggaaccgauggaccauguaaaguaccagcacaaauggcaguagauaugcaaacauuaacaccuguaggaagacuuaucacagcaaauccuguuauaacagaaagcacagaaaauucaaaaaugauguuagaauuagacccaccauucggugauaguuacauaguaauaggaguaggcgagaagaaaauuacacaucauuggcauagaucaggauccacaauagguaaagcguucgaagcaacagugagaggagcaaaaagaauggcaguauuaggggauacugccugggauuuuggaucaguagggggagcauuaaauagucuaggaaaagguauacaccaaauuuuuggagcggcuuuuaaaucucuauuuggugggaugucaugguuuucacaaauacuaauaggcacacuacucauguggcuaggauuaaacacgaaaaauggaagcauaucauuaaugugucuagcacuaggagguguccuaauauuccugucaacagcaguaagugcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10278 - RNA, 2029 nt, Artificial Sequence
  ZIKV (isolate Z1106033) ME variant mRNA Design 1 opt
gggagaaagcuuaccaugggaaaaaggagcgcaggaucaaucaugugguuagcaucauuagcaguaguaauugccugcgcuggugcagcaguaacauugccaagucauucuacaagaaaacuacagacaagaagccaaacauggcuagaaucuagagaauacacaaaacauuuaauaagaguugaaaacuggauauuuagaaauccaggauuugcacuagcagcagcagcaauagccugguuauuaggaaguucaacaagucaaaaaguaauuuacuuaguaaugauacuauuaauagcuccagcauauaguauaagauguauaggaguaucaaauagagauuuuguugaagguaugaguggaggaacauggguagauguuguacuagaacauggaggauguguaacuguaauggcacaagauaaaccaacagucgacauugaacuaguaacaacuacagugucuaacauggcugaaguaagaucauauugcuaugaagcaucuauaagugauauggcaucagauagcagauguccuacucaaggagaagcauaucuugauaaacaaucagauacacaauauguauguaaaagaacauuaguagauagaggauggggaaaugguuguggcuuauuuggaaaaggaagucuaguaacaugugcaaaauuugcaugcaguaaaaaaaugacgggaaaaaguauacagccagaaaaccuagaauacagaauuauguuaagcguucaugguagucaacauaguggaaugauaguaaacgauacugggcaugaaacugacgagaauagagccaaaguagaaauaacaccaaauucaccgagagcagaagcuacacuugguggauucggaucacuuggucuagauugcgaaccaagaacaggacuugacuucucagaccuauauuaucuaacaaugaauaauaaacauugguuaguucauaaagaaugguuucaugauauaccauuaccauggcaugcaggagcagauacgggaacaccacauuggaauaauaaagaagcacuagucgaauuuaaagaugcacaugcaaaaagacaaacgguaguuguacuaggaucacaagaaggagcaguacauacagcauuagcuggggcuuuggaagcagaaauggauggcgcgaaaggaagacuaucaaguggacauuuaaaaugccgauugaaaauggauaaauuaagauuaaaaggaguaaguuacucauuauguaccgcugcguuuacauuuacgaaaauuccagcagaaacguuacauggaacaguaacagucgaaguucaauaugcaggaacagacggaccauguaaagugccagcacaaauggcaguagacaugcaaacauuaacaccagugggaagauuaauaacagcaaacccaguaauaacagaaucuacggaaaauagcaaaaugauguuagaacuagacccacccuucggagauucauauauuguaauaggaguuggagaaaaaaaaauuacgcaucacuggcauagaagugguaguacaauuggaaaagcauuugaagcuacaguaaggggagcaaaaagaauggcaguacuaggagauacugcaugggauuucgguaguguuggaggugcacuaaauagccuuggaaaaggaauucaucagauauuuggagcagcauuuaaaucauuauuuggaggcaugaguugguucagucaaauauuaauuggaacucuauuaaugugguuagguuuaaacgcaaagaauggaucaauaaguuuaauguguuuagcacuaggaggaguauuaauauuccuuucaacagccguuucggcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10279 - RNA, 2017 nt, Artificial Sequence
  ZIKV (strain MR 766) ME variant mRNA Design 1 opt
gggagaaagcuuaccaugggaaaaagaucagcaggaaguauaaugugguuagcaucacuagcaguaguaauagcaugugcuggagcagcaguaacauuaccaucacauucaacaagaaaauuacagacaagaagccaaaccugguuagaaucaagagaauacacaaaacauuuaauaaaagucgaaaacuggauauuuagaaauccaggauucgcucuaguagcaguagcaauagcuugguuacuaggaucaagcacaucacaaaaagugaucuaucuaguuaugauacuauuaauagccccugcauauucuauaaggugcauaggaguaagcaacagagauuuugucgaaggaaugucaggaggaacauggguagauguugucuuagaacauggagguugcguuacaguaauggcacaagauaaaccaaccguggauauugagcuaguaacgacaacaguaaguaacauggcagaaguaagaaguuauuguuacgaagcaaguauaucagacauggcaucagauucaagauguccgacucaaggagaagcauaucuagauaagcaaucagauacacaauacguuugcaaaagaacauuaguagauagaggauggggaaauggaugcggauuauuuggaaaaggaaguuuaguaacaugcgcaaaauuuacuuguaguaagaaaaugacaggaaaaaguauucaaccugaaaaucucgaauauagaaucaugcuaaguguucauggaagccaacauucuggcaugauaggauaugaaacagaugaagauagggcaaaaguagaaguuacaccuaauucaccaagagcagaagcaacauuaggagguuuuggaaguuugggacuagacugugaaccucgaacugguuuagacuuuagugauuuauacuauuuaacgaugaauaauaaacauuggcuuguacauaaagaaugguuucaugacauaccauuaccauggcacgcaggagcagauacaggaacaccacacuggaauaauaaagaagcauuaguagaguuuaaagaugcucaugcaaaacgacaaacagugguaguauuaggaucucaagaaggagcuguacauacagcucuggcgggugcauuggaagcagaaauggauggagcaaaaggacgacuguucagcggacauuuaaaaugcaggcuuaaaauggauaaauuaagauuaaaaggaguaucauauucacuauguacagcugcuuuuacauucacaaaagucccagcagagacucuacauggaacaguaacuguugaaguacaauaugccggaacagauggaccauguaaaauuccuguacaaauggcaguagauaugcaaacacuuacuccaguaggaagauuaauaacggcaaaccccguuauaaccgaaucaacagaaaauaguaaaaugaugcuagaacuagauccuccauuuggugauucauauauaguaauaggaguaggagacaagaaaauaacacaccauuggcauagaaguggaaguacuauaggaaaagcauuugaagcaacagugagaggagccaaaagaauggcuguacuaggagauacagcaugggauuucgguucaguaggcggaguuuuuaacucauuaggaaaagggauacaucaaauauuuggagcagccuucaaaucacuguucggcggaaugagcugguuuucucaaauauugauugggacccuauugguauggcucggacuaaauacuaaaaaugguagcauaucauuaacaugccuagccuuaggaggaguaaugauuuuccuuagcacagcaguuagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10280 - RNA, 2029 nt, Artificial Sequence
  ZIKV (strain NatalRGN) ME variant mRNA Design 1 opt
gggagaaagcuuaccaugggcaaaagaucagcaggaagcaucaugugguuagcuaguuuagcagucguaauagccugugcaggagcagcaguaacauuaccgagccacucaacaaggaaauugcaaacccggagccaaacauggcuagaaaguagagaauauacaaaacaucuaaucagagucgaaaacuggauauucagaaauccuggauuugcauuagcagcagcagcaauagcauggcuauuaggaucaaguacaagucaaaaaguaauauaucuaguuaugauauuacuaauagcaccagccuacucaauaagauguauaggaguaagcaauagagacuuugucgaaggaaugagcggaggaacuuggguagauguaguauuagaacacggagguugcguaacggucauggcacaagacaaaccaacaguagacauugaauuaguaacaacgacaguuucaaauauggcagaaguccgaaguuacuguuaugaagcgucaauaucugacauggcaagugacucuagauguccuacucaaggagaggcuuauuuagauaaacaaagugauacacaauauguauguaaacgaacguuaguggauagaggaugggguaaugguugcggucuguucgguaaaggaucucuaguaacaugugcaaaauuugcuuguuccaagaaaaugacaggaaaaucaauacaaccagaaaauuuagaauaucgaauaauguuaaguguacauggaagucaacauaguggaaugauuguaaaugauacaggacaugaaacagaugaaaauagagcaaaaguggaaauaacuccaaauucaccaagagcagaagcuacauuaggaggcuuugguagcuuaggauuagacugcgaaccaaggacgggucuagacuuuagugaccuuuauuaucuaacaaugaauaauaaacauugguuaguacauaaagaaugguuccaugauauuccauuaccauggcacgcaggagcagauacuggaacaccacauuggaacaauaaagaagcauugguugaauuuaaagaugcacaugccaaaagacaaacaguaguaguacuuggaucccaagaaggagcaguacauacagcauuagccggugcauuagaagcagaaauggacggagcaaaagguagacuuagcagcggacaucuuaaauguagacuaaaaauggauaaauuaagauuaaaaggaguaucuuauagucuaugcacagcagcauucacuuuuacuaaaauacccgcagaaacguuacauggaacaguaacaguagaaguacaauaugcaggaacagauggcccauguaaaguaccagcacaaauggcaguugauaugcagacauuaacaccuguaggaagacuaauaacagcaaauccaguaauaacagaaucaacagaaaauaguaaaaugauguuggaauuagauccaccauucggagauucuuacauaguaauaggaguaggagaaaagaaaauaacccaucauuggcauagaucaggaaguacaauuggaaaagcauuugaagcaacaguaagaggagcaaaacgaauggcaguacuuggagacacagcaugggauuuugguucgguaggaggagcauuaaauucacuagguaaaggaauacaucaaauauuuggagcagcguuuaaaucacucuucgguggaaugucaugguucagucaaauucuaauaggaacauuauuaauguggcucggucuaaauacgaaaaauggaucaauuucacucauguguuuagccuuagguggaguccucauauucuuaucaacagcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10281 - RNA, 2305 nt, Artificial Sequence
  ZIKV (strain ZikaSPH2015) prME-short variant mRNA Design 1 opt
gggagaaagcuuaccauggccauaagcggcguacccguccucggauucuucauaaucgcaguccucaugagcgcccaagaaaguugggccgucacccgcagaggaagugcauacuacauguaccucgaccgcaacgacgcgggagaagccaucuccuucccaaccacccuaggcaugaacaaaugcuacauccaaaucauggaccuaggacauaugugcgacgccacaaugagcuacgaaugccccaugcucgacgaagguguagaacccgacgacguagacugcuggugcaacacaacaucaaccuggguaguauacggaacaugccaucacaaaaagggagaagccagacgcagccgcagagccguaacacuacccucacacucgacacgaaaacuucaaacacggucacagaccuggcuagaaucccgugaauacaccaaacaccuuauaagaguagagaacuggaucuuccgaaaccccggguucgcccucgccgccgccgccaucgcauggcuacucggcuccagcacaucacaaaaaguuauauaccuaguuaugauccuccugauagccccugccuauagcauaagauguauaggcguaucaaaccgcgacuucguagaaggcaugucaggcggaacauggguggacauaguccuagaacacggcggcugcgucaccguaauggcccaagacaaaccaaccguagacauagaacuuguaaccaccacggugucaaacauggccgaaguacggagcuacugcuacgaagccucaauuuccgacauggcgagcgacuccaggugcccgacacagggagaagcauaccucgacaagcaaucagacacccaguacgucugcaagagaacacucguagacagaggcuggggaaacgguugcggacuguucggcaaaggcagccuggucacaugcgcgaaauucgccuguagcaaaaagaugaccggaaagucgauccaacccgaaaaccuagaauacaggaucaugcugagcguccauggcagccaacacagcggcaugaucguaaacgacaccggacacgaaaccgacgaaaaccgggcuaaaguagaaaucaccccaaacucccccagagccgaagccacgcuagggggauucggcucacuugggcucgacugcgaacccagaaccggacuagauuucagcgaucuauacuacuuaaccaugaacaacaaacacuggcucguacacaaagagugguuccacgacauaccccugccauggcacgccggcgccgacaccggcacaccacacuggaacaacaaagaagcgcuuguagaguucaaggacgcacacgcuaaacgccaaaccguaguagugcuggggagccaagaaggcgcgguacacacggcccucgccggggcacuagaagcagaaauggacggagccaaggggcggcugucaagcggccaccugaaaugccgccucaaaauggacaaacuuaggcuuaaaggagucuccuauagccuaugcacggccgccuucaccuucacaaaaauaccagccgaaacccuccacggcacuguaacagucgagguccaauacgccggcacagacggacccuguaaaguaccagcgcagauggccguagacaugcaaacgcuuacacccguaggacgccuaaucacagcaaacccaguaaucaccgaguccacagaaaacagcaaaaugaugcuugaacucgaucccccauucggggacuccuacauagucaucggcgucggcgaaaagaaaauaacccaccacuggcaccgcuccggcucaacgauaggaaaggcauucgaagcaacaguaagaggagcaaaaagaauggcaguccucggggacacagccugggacuucggaucgguaggcggcgcccucaacagccucggaaagggcauacaccaaaucuucggagcagccuucaaaucacuauucggaggcaugagcugguucagucaaauccugaucggcacccuccucauguggcucggccucaacacgaaaaacggauccaucucccucaugugccuagcacucggcggaguccucauauuccuuuccaccgcggugagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10282 - RNA, 2305 nt, Artificial Sequence
  ZIKV (isolate Z1106033) prME-short variant mRNA Design 1 opt
gggagaaagcuuaccauggcaauaucgggaguacccguacugggauucuucauaauagcaguccucauguccgcacaagaauccugggcagucacaagacgcggauccgccuacuacauguaccuagaccgaaacgacgccggcgaagccaucucauucccaacaacacuaggaaugaacaaaugcuacauccaaaucauggaccucggacauacgugcgacgcaacaaugagcuacgaaugccccaugcuggacgaaggaguagaaccagacgacgucgacugcuggugcaacacaaccagcacuuggguaguauacggcacaugccaccacaagaaaggcgaagccagacgaagcagaagggcaguaacccuaccuucgcacucgacccgaaaacugcagacaagaagccagacauggcuggaaucacgcgaauacacaaaacaccucauacgagucgagaacuggaucuucaggaaccccggauuugcccuggcggccgccgcaaucgcauggcuccucggcagcucaacgucacaaaaaguaauauaccuggucaugauccuacucaucgcacccgccuacagcaucagaugcauaggagucagcaaccgggacuucguagaaggcaugagcggcggcaccuggguagaugugguucuagaacacggcgguugcgucacagugauggcacaagacaaacccaccguagauauagagcuagucaccaccaccgucagcaauauggccgaaguccggagcuacugcuacgaagccagcaucagcgacauggcauccgacagccgcugcccaacccaaggagaggcauaccuagacaaacaaagugacacacaauacgucugcaaacgaacacucguagacagaggcuggggcaacggauguggccucuucgguaaaggcucacucgucacaugcgcaaaauucgcaugcagcaagaaaaugaccggcaaaagcauccaaccagaaaaccuugaguauagaaucaugcuaucgguacacggaucccaacauucaggcaugaucguaaacgacacgggccaugaaacagacgaaaaucgagccaaaguagaaauaaccccgaacagcccgagggcagaggcaacacucgguggauuuggcagccugggccucgacugcgaaccccgaaccggucuugacuucuccgaccuguacuaccuaacaaugaacaacaaacacuggcucgugcauaaagagugguuccacgacaucccacugcccuggcacgccggcgcagacaccgguacgccacacuggaacaacaaagaagcacucgucgaguucaaagacgcacacgcaaaacgccaaacgguaguaguccucggcucacaagaaggagccgugcacaccgcccuagccggcgcacucgaagcagaaauggacggcgcaaaaggccgacucuccucaggccaccucaaaugccgccuaaaaauggacaaacugcgccucaaaggagucagcuacuccuuaugcacagcagccuucaccuucacaaaaauaccugcagaaacccuucacggcaccgucaccgucgaaguacaauacgcagguaccgacggccccugcaaaguaccagcccaaauggccguagacaugcaaacccugacccccgugggcagacuuauaaccgccaaccccguaauaacagaaagcaccgaaaacucaaaaaugaugcucgaacucgaucccccguucggcgacagcuauauagucaucggagucggcgaaaagaaaaucacacaucacuggcacagaucaggaagcaccaucggaaaagccuucgaggcgacaguacgcggagccaaacggauggccguccucggagacaccgccugggacuucggaucaguaggaggggcacuuaacucccuaggaaaaggcauccaccaaaucuucggcgcagccuucaaaucacuauucggggguauguccugguucucccaaauccuaaucggaacucuccucauguggcucggacucaacgcgaaaaacggcaguaucagccucaugugccucgcacuaggaggagugcuaauauuccuaucaacagcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10283 - RNA, 2293 nt, Artificial Sequence
  ZIKV (strain MR 766) prME-short variant mRNA Design 1 opt
gggagaaagcuuaccauggccaucucaggcgucccagugcucggauuuuucaucauagcaguauuaaugagcgcgcaagaaaguugggcaauaaccagacgcggcuccgccuacuacauguaccuggaccgcuccgacgcaggcaaagccaucagcuucgcaaccacccucggaguaaauaagugccacgugcaaauaauggaccuaggccacaugugcgacgccacaaugucauacgaaugcccgaugcucgacgaaggaguagaacccgacgacguggacugcuggugcaacacaacguccacauggguaguauacggaaccugccaccacaagaaaggagaggcaaggcgaagccgcagagcaguaacccuacccagccacaguacacgaaaacuacaaacgcggagccaaacuuggcuggaaucacgcgaauacacaaaacaccuaauaaaaguggaaaacuggauauuccggaaccccggauucgcacugguggcaguagcgauagccuggcugcucggcagcucaaccucccaaaaagucaucuaccucguaaugauacuccugauagcaccagcguacuccauaaggugcauaggcgucagcaaccgugauuucgucgagggaaugucaggaggaaccuggguagacguaguccuagaacacgggggcugcgugaccgucauggcccaggacaagccuacagucgacauagaacucgucacaaccacgguaagcaauauggcagaaguaagaagcuacuguuacgaagcaucaaucagcgacauggccagcgacucaagaugcccaacccaaggagaagccuaccuagacaaacagagcgacacccaauacgucugcaagcggacgcucguagacagaggcuggggaaauggaugcggccucuucggaaagggaagccuagugaccugcgccaaauucacaugcagcaagaaaaugacaggaaaauccauccaacccgagaaccucgaauaccgcauaauguuaagcguccacgggucacaacauagcgguaugaucggcuacgaaaccgacgaagacagggcaaaaguagaaguaacccccaacagcccaagagcugaagccacacucggaggauucggcagccuaggacuagacugcgaaccacgcacuggacuugacuucuccgaccuauacuaccucacgaugaacaacaagcacuggcuaguccacaaagaaugguuccacgacauaccccuaccuuggcacgccggcgcggacaccggaacaccacacuggaacaacaaagaggcacucgucgaguucaaggaugcacaugccaaacgccaaacagucguaguacugggaagccaggaaggagccguacacacagcccucgcaggagcacucgaagcugaaauggacggcgcaaaaggccggcuuuucagcggccaccucaaaugccggcuaaaaauggacaaacuccggcugaaagggguaagcuacagccucugcaccgcagcguuuacguucaccaaaguacccgcagaaacacuacacggcacaguaacagucgaggugcaauacgcaggcaccgacggccccugcaagauaccaguacaaauggcagucgacaugcaaacacugacaccugucgggcgacuaauaaccgcaaacccagucaucaccgaaagcaccgagaacagcaaaaugaugcucgagcuagacccaccauucggcgacagcuacaucgucauaggcgugggcgacaagaaaaucacacaccacuggcacagguccggcagcaccaucggcaaagccuucgaagcgacaguacgcggagcaaaacgaauggcagucuugggcgacacagccugggacuucggcagcgucggcggagucuucaacucacuagggaaaggaauacaccagauauucggagccgccuucaagagccuauucggaggaaugagcugguuuagccagauacucauaggcacccuacucgucuggcuaggucuaaacacaaagaacggcuccaucucauuaacaugccuggcauugggcggagugaugauauuucucagcacagccguaagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10284 - RNA, 2305 nt, Artificial Sequence
  ZIKV (strain NatalRGN) prME-short variant mRNA Design 1 opt
gggagaaagcuuaccauggccauauccggcguaccaguccucggguucuucauuauagcaguccucaugagcgcacaagaaucgugggccguaaccagacgaggaucugcauauuacauguaccuagaccggaacgacgcgggagaagccaucucauuucccacaacacucggaaugaauaaaugcuacauccaaaucauggaccucggccacaugugcgacgcaacgaugagcuacgaaugccccaugcuagacgagggggucgaacccgacgacgucgacugcuggugcaacacaacaucaaccuggguaguauacggcacaugccaccacaaaaagggcgaagcccgacgauccaggcgagcaguaacauuacccucccauuccacccgcaaacuccaaacgcgcucgcaaaccuggcuagaaucacgagaauacacaaaacaccucauccgaguagaaaacuggaucuucagaaauccgggauucgcccuggccgcugccgccaucgccuggcuacucggcuccagcaccucacagaaagucaucuaccucguuaugauacuccucauagcgccagccuacucuauccgcugcaucggaguaagcaaccgagauuucguagaaggcaugucaggcggcacaugggucgacgucguccuagaacacggaggcugcguaacagucauggcccaagacaaaccgaccgucgacaucgagcuaguaaccacaaccgucuccaauauggccgaaguccgaagcuacugcuacgaagcgucaaucuccgacauggcaagcgacucccgaugcccaacccaaggcgaagccuaccuagacaaacaguccgacacccaauacguuugcaaacgcacacucgucgaccgaggauggggcaacggcugcggccucuucgggaaaggaagccucguaaccugcgcaaaauucgcaugcagcaagaaaaugaccggaaaauccauccaacccgaaaaccuggaauaccgcauaaugcucucaguacacggaucccagcacagcggaaugauagugaacgauacaggacacgaaacugacgaaaaccgagcaaaaguagaaaucacccccaacucaccacgagcagaagccacccuaggcggauucggcucauuaggccucgacugcgaaccuaggacgggccucgacuucuccgaccuauacuaccugacaaugaacaacaaacacuggcuaguacacaaagaaugguuucacgauaucccccuacccuggcacgccggcgccgacacaggcacaccgcacuggaacaacaaggaagccuuaguagaguucaaagacgcccacgccaagcgccaaaccgucgugguccugggaucccaagaaggcgccguacacaccgcccuagcaggcgcccuugaggccgaaauggacggggcaaaaggccgccuaucauccggacaucucaagugccggcucaaaauggacaaacuacgacuaaaaggcguaagcuacucccucugcacagccgcuuucacauucaccaaaauaccagcggaaacucuccacggcaccgucaccgucgaagugcaauacgccggaacagacggaccaugcaaagugcccgcccaaauggccgucgacaugcagacucuaaccccaguagggcgacucauaaccgcaaaucccgucaucaccgaaagcaccgagaacagcaaaaugaugcucgaacuggacccucccuucggcgacagcuacaucgucaucggaguaggcgaaaagaaaaucacccaccacuggcaccgaucgggaagcaccaucggcaaagccuucgaagcgacagucagaggcgcaaaacgcauggccguccucggagacaccgcaugggacuucggcagcgucggaggcgcacucaacucucugggcaaagggauccaccaaauauucggcgccgccuucaaaucccucuucgggggaaugucgugguucucacagauacuuauaggaacacuacucauguggcucggacuaaacaccaaaaacggcuccauaucccucaugugccuagcccuaggaggaguccuaaucuuccucucgacagcggucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10285 - RNA, 2284 nt, Artificial Sequence
  ZIKV (strain ZikaSPH2015) prME-short variant mRNA Design 1 opt
gggagaaagcuuaccauggacuggacauggauacucuuccuaguagccgccgccacccgcguacacucagugacgcgccgcggcucagcauacuacauguaccucgaccggaacgacgccggagaggcgauaucauuccccaccacacuaggaaugaacaaaugcuacauacagaucauggaccucggccacaugugcgacgccacaauguccuacgagugcccaaugcuggacgaagggguagaaccagacgacgucgacugcuggugcaacaccacguccacauggguggucuacggcacaugccaccacaagaaaggagaagcgcgccgaucacgcagagccgucacccucccaagccacuccacaagaaaacuccaaaccagaagccaaacuuggcucgaaucccgggaauacaccaagcaccucauacgcguagagaacuggauauuccgcaacccaggcuucgcgcuagcagccgccgccauagccuggcuacuaggcucauccacaucacaaaaagugaucuaucuaguaaugauacuacuaauagcacccgccuacagcaucagaugcauaggcgucucaaacagagacuucguagaaggcaugucaggaggaaccuggguagauaucguacucgaacacggcggauguguaaccgucauggcccaagacaaacccacuguagauaucgagcuaguaacaacaacaguauccaacauggccgaaguaagauccuacugcuacgaagcaucaaucucagacauggccucagacucgaggugcccuacucagggagaagccuaccuagacaaacaaagcgacacgcaauacgucugcaaaagaacccuagucgauagaggcuggggaaacgggugcgggcuauucggcaagggaucacucguaaccugcgcaaaguucgcaugcuccaagaaaaugaccgguaaaagcauccaacccgaaaaccucgaauacagaaucaugcuaucgguacacggaucccagcacuccggaaugauuguuaacgacacgggucacgaaacagacgaaaaccgggccaaggucgaaauaacaccaaacagcccacgagcagaagccacccuaggaggcuucggcucccucggccucgacugcgaaccccguaccggcuuggacuucagcgaccuauacuaccucaccaugaacaacaaacacuggcugguccacaaagaaugguuccacgacauuccccuccccuggcacgcaggggccgacacaggaaccccacacuggaacaacaaagaggcccuuguagaguucaaagacgcacacgcaaaacgccaaacagucgucguccucggcucgcaagaaggagccguacacacagcacuagccggcgcacuagaagcagaaauggacggcgcaaaaggccgccuaagcucaggccaccucaagugccggcucaagauggacaaacuacgccuaaaaggagucucauacucccuaugcaccgcggccuucaccuucaccaaaaucccggcagagacccuacacggaaccguaaccguugaaguucaauaugccggaaccgacggacccugcaaaguacccgcccagauggcagucgacaugcaaacacuuaccccaguuggccgccucaucacggcaaaucccgucaucaccgaaaguacagaaaacucaaaaaugaugcuagaacuagacccgcccuuuggcgacucauacauagucauagggguaggagagaaaaagauaacccaccacuggcaccgcagcggguccacgauagguaaagccuucgaagcaaccguaagaggcgcgaaacgaauggcaguacuaggugacaccgcaugggacuucgggagcgucggcggggcacuaaauucacuugggaagggaauccaccaaaucuucggggccgcauucaagagucucuucggcggcaugagcugguucucacaaauccucauaggaacccuccuaauguggcuaggccucaacaccaaaaacggaagcauaucccuaaugugccuagcacucggaggcguacucaucuuccucagcacagcgguaagcgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10286 - RNA, 2284 nt, Artificial Sequence
  ZIKV (isolate Z1106033) prME-short variant mRNA Design 1 opt
gggagaaagcuuaccauggacuggacguggauacuauuccucguagccgccgcaacccgcguccacagcguaacccgaagaggcuccgcuuacuacauguaccucgaccgaaacgacgccggcgaagccauaucauuccccaccacccucggcaugaacaaaugcuacauccaaauuauggaccuagggcacacuugcgacgccacaaugagcuacgagugccccaugcucgacgaaggcgucgaaccagacgacguggacugcuggugcaacaccaccagcacauggguaguauacggaaccugccaccacaagaaaggcgaagcccgaagaucacgccgggccguuacccuccccucacacuccacacgaaagcuccaaacccgcucccaaaccuggcucgaaucucgagaauacacaaagcaccuuauaagaguugagaacuggaucuucagaaaccccggcuucgcccuagccgcagccgcaaucgccuggcuccucggcuccucaacaucccaaaaagucauauaccuugucaugauccuccucauagcaccagccuacucgauccgaugcaucggcguuuccaaccgcgacuuugucgaaggcaugaguggaggcaccugggucgacguaguacuagaacacggaggcugcgucacaguaauggcacaagacaaaccgacaguagacaucgagcuaguuacaacaaccguaucuaauauggccgaaguccgcucauacugcuacgaagccuccaucuccgacauggcauccgacuccagaugcccuacccaaggcgaagccuaccucgacaaacaauccgacacccaauacgucugcaaacgcacccucguagaccgaggguggggcaacgguugcggccuguucggaaagggaucccuagucacaugcgcaaaguuugccugcuccaagaaaaugacgggaaaaucaauacaacccgaaaaccuagaauaccgcauaaugcucagcguccacgggucacaacacagcgguaugauagugaacgacacuggacacgaaacagacgagaacagagcgaaagucgaaaucacaccgaacuccccucgcgcagaagccacgcuaggaggguucggaucacuuggacucgacugcgaaccccgcaccggccucgacuucagcgacuuauacuaccuaacaaugaacaacaaacauuggcuaguccacaaagaaugguuccacgacauaccccuacccuggcacgccggcgcagacacaggaacaccccacuggaacaauaaagaagcccucgucgaguucaaagacgcccacgcgaaaagacaaaccgucguuguacugggcagccaagaaggcgccguccacaccgcacuagcgggggcucuagaagcagaaauggauggcgccaaggggcgacuaucaucaggccaccucaaaugcagacuaaaaauggacaaacuccgccucaaaggaguaucauacucacuaugcaccgccgcguucacauucaccaaaauacccgcugaaacucuccacggaacagucaccgucgaaguccaauacgcaggaaccgacggccccugcaagguaccagcccaaauggccguagacaugcaaacacuaacccccgucggaagacuaaucaccgcgaaccccguaauaacagaauccacagagaacucaaaaaugaugcucgaacuagacccaccguucggagacucuuacauagucauaggagucggagagaaaaagaucacacaccacuggcaccgcucaggcucaacaauuggcaaagccuucgaagccacgguacggggagccaaaagaauggccguacuaggggacacagccugggacuucggaucagucggcggugcacuaaauucacuaggaaaaggcauccaccagaucuucggcgcagccuucaaaagccuauuugguggaaugucaugguucagccaaauccucauagggacccuccucauguggcucggccucaacgcuaaaaacggaagcaucucgcuaaugugccuagcccucgggggcguccuaauauuccucagcacggcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10287 - RNA, 2272 nt, Artificial Sequence
  ZIKV (strain MR 766) prME-short variant mRNA Design 1 opt
gggagaaagcuuaccauggacuggaccuggauacuguucuuaguagccgccgccacgcgaguccacagcauaacacgcaggggaucagcauacuacauguaccucgaccgauccgacgccggaaaagcaauaucauucgcaaccacgcuaggagucaacaaaugccacgugcaaaucauggaccuaggucacaugugcgacgccaccauguccuacgagugcccuaugcucgacgaaggaguagaaccagaugacgucgacugcugguguaacacaaccuccacaugggucgucuacggcacaugccaccacaagaaaggagaagccagacgaagccgucgcgccgucacacuaccaagccacagcacaagaaaacuccaaacccggucacaaacauggcuugaaagccgagaauauacaaaacaccucauaaaaguagaaaacuggaucuuccggaacccaggguucgcgcucguagccguggcaauagccuggcuccucggauccagcacaucccaaaaagucaucuaccuaguaaugauccucuugauagcacccgccuacucaauacgaugcauaggagucagcaaccgcgauuucguagaaggaauguccggcggaacaugggucgacgucguccucgaacacgguggaugcgucaccgucauggcacaagacaaacccacagucgacauagagcuagucaccacaacuguaagcaacauggccgaaguacgcuccuacugcuaugaagcauccauauccgacauggcaucggacagccgcugcccaacgcaaggcgaagccuaccuagacaaacaaucagauacccaguacgucugcaaaaggacccuaguagaccgaggauggggcaacggaugcggacucuucggaaaaggcagccuaguaaccugcgcaaaauucacaugcuccaagaaaaugacaggaaaaagcauacaaccggaaaaccuagaguacaggaucaugcuaagcgugcacggcucccaacacucaggaaugauaggcuacgaaaccgacgaagaccgagcaaaagucgaaguaacacccaacucaccccgggcagaagcaacccuagggggauucggaucccuaggacucgacugcgaaccccgcacaggacuggacuucuccgaccuauacuaccuaacgaugaacaacaaacacugguuaguccacaaagagugguuccacgauaucccccuaccauggcacgccggagccgacacaggaacgccacacuggaacaacaaagaagcccuagucgaguucaaagacgcacacgccaaaaggcagacagucguagugcuaggcucgcaagaaggggcaguccacaccgcacucgccggagcacuagaagccgaaauggacggagccaaggggcggcuauucucaggccaccugaaauguagacuuaagauggauaaacugcgacuaaaaggagugagcuacucccucugcacagccgcauucacguucacaaaaguaccggccgaaacacugcacgggacagucaccguugaaguccaauacgcagggacugacggccccugcaaaauccccguccaaauggccgucgacaugcaaacccuaacccccguaggacgacuaaucacggcaaacccuguaauaacagaaucaacagaaaacagcaaaaugaugcuugaacuagacccaccauucggagacuccuacaucguaaucggaguaggugacaagaagauaacacaccacuggcacagaagcggcuccacaaucgggaaagcguucgaagccacaguccgcggcgccaaaagaauggcuguacuaggagacaccgcaugggacuucggcuccguaggcggagucuucaacucgcuagggaaaggaauacaccaaauauucggagcagccuucaaaucccuauucggaggaauguccugguucucgcaaauccuaaucggcacacuccuggucuggcuaggacuaaacacgaaaaauggaagcauuucccuaacaugccucgcccucggaggaguaaugauauuccucagcaccgccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10288 - RNA, 2284 nt, Artificial Sequence
  ZIKV (strain NatalRGN) prME-short variant mRNA Design 1 opt
gggagaaagcuuaccauggacuggaccuggauacuauuccucguagccgccgcaacacgaguccacagcguaaccaggcgcggaucagccuacuacauguaccuggaccgaaacgaugccggcgaggcgauaucauuccccacaacccucggcaugaacaaaugcuacauccagaucauggaccucgggcauaugugcgacgccaccauguccuaugaaugcccgaugcucgaugaaggagucgaaccagacgacgucgacugcuggugcaacaccaccagcaccugggucguauacggaaccugccaccacaagaaaggcgaagcccgccgaagcagacgcgcagucacacuaccaagccacucaacacgaaaacuacaaacccgaucacaaaccuggcucgaaucccgagaauacacaaaacaccuaauccgagucgaaaacuggauauuccgaaacccaggauucgcccucgcggccgccgccauagccuggcuacugggauccagcacaagccaaaaagucaucuaccuugucaugauccuacuaaucgccccagccuacuccauacgaugcaucggagucagcaacagagacuucgucgaaggcaugucaggaggaacauggguagacguaguacucgaacacggcggcugcguaaccguaauggcccaagacaaacccacaguagacauagaacuuguaaccaccacagucuccaacauggcagaaguccgcucauacugcuacgaagcauccaucagcgacauggcaagcgacucacgcugcccaacccaaggcgaagcauaccuggacaaacaaagcgacacgcaauacgucugcaaaagaacacucguggaccgcggauggggcaauggaugcggccucuucggcaaggggagccuagugaccugcgcaaaauucgccuguucaaagaaaaugaccggcaaaagcauacaaccugagaaccucgaauaccgcauuaugcugagcguccacgggagccaacacagcggcaugaucguaaacgacaccggucacgaaaccgacgaaaaccgcgccaaagucgagaucaccccaaacucaccccgcgccgaggcuacacugggaggauucggcucacuagggcuugacugcgaaccgagaacaggcuuagacuuuucagaccuuuacuacuuaaccaugaacaacaaacacuggcucguccacaaagaaugguuucacgacaucccccugccauggcacgccggcgcugacaccgguacaccacacuggaacaacaaagaggcccuaguagaguucaaagacgcccacgcaaaacgccaaaccguagucguacuaggcucccaagaaggagcaguacacaccgcccuggccggagcacuagaagcagagauggacggagccaaggggcgccucagcuccgggcaccucaaaugucgccugaaaauggacaagcuaaggcuaaagggcguauccuacucccuaugcacagccgccuucaccuucaccaaaaucccagcagaaacccuccacggaacggugacuguggaaguccaauacgcaggaaccgauggacccugcaaaguacccgcacagauggcgguggacaugcaaacccuaacgcccgucggacgccucauaaccgccaacccagucauaacagaaucaacagaaaacagcaaaaugaugcucgagcucgacccacccuucggagacagcuacaucgucaucgggguaggcgaaaagaaaauaacccaccacuggcacagaucaggaucuacaaucggaaaagccuucgaagccaccguccgcggugcgaaacgaauggccguccuaggcgacaccgccugggacuucggcagcgucgggggcgcacucaacucccuaggaaaaggcauccaccaaaucuucggcgccgccuucaaaagccucuucggaggcaugucaugguucagccagauccucauaggcacacuccuaauguggcuaggccucaacaccaaaaacgggucaauuagccuaaugugccucgcacugggaggcgugcuaaucuuccuaagcaccgcagucucggcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10289 - RNA, 2302 nt, Artificial Sequence
  ZIKV (strain ZikaSPH2015) prME-short variant mRNA Design 1 opt
gggagaaagcuuaccaugggaaaaagaagcgcaggaucaauaauguggcuagcuucccuggccguaguaaucgccugcgcaggcgcaguaacacgucgaggguccgcauacuacauguaccucgauaggaacgacgcaggagaggcaaucucuuuccccaccacacuaggcaugaacaaaugcuacauccaaaucauggaccuaggacacaugugcgacgccacuauguccuacgaaugccccaugcuagacgaaggaguagaaccggacgacguugacugcuggugcaacaccacaucaaccugggucgucuacggaacaugccaccacaagaaaggagaagccagacgaagcagacgagccguuacacuaccaucccacagcacaagaaaacuacaaaccagaucacagaccuggcuagaaagcagagaauacaccaaacaucuaauccgagucgaaaacuggaucuucagaaaccccggcuucgcccuggcagcagccgcaauagccuggcuccucggcagcaguacaucccaaaaagugauauaucucgucaugauacuauugaucgcacccgcauacagcaucagauguauaggcgucagcaaccgugacuucguagagggaaugagcggcgggaccugggucgacaucguccuggaacacggcggaugcguaaccguuauggcacaggacaaacccaccguagacaucgagcuaguaacaaccacagucuccaacauggccgaaguacgcuccuacugcuacgaagcguccauaagcgacauggcaagcgacagccgcugcccaacccaaggggaggcauaccuagacaaacaaagcgacacucaguacgucuguaaaagaacacucguagacagaggauggggcaauggaugcggccuauucggaaaaggcagccucguaaccugcgccaaauucgcaugcaguaagaaaaugaccggaaaaagcauacaacccgagaaucuagaguaccggaucaugcucagcguacacggcucccaacacuccggaaugauaguaaacgacacaggacacgaaacagacgaaaaccgggccaaagucgagaucacaccaaacuccccaagggccgaagccacccugggcgguuucggcagccuaggacuagacugcgaaccccgcaccggccucgacuucagcgaccuauacuaccuaaccaugaacaacaaacacugguuaguccacaaagaaugguuccacgacauaccccucccguggcacgcaggcgcagacaccggcaccccucacuggaacaacaaagaagcacucgucgaguucaaagacgcccacgccaaaaggcaaaccgucgucguacucgggucacaagaaggagccguacacaccgcacuagccggagcccuagaagcagaaauggacggcgcaaaagggagacuauccuccggccaccucaaaugccgacugaaaauggauaaacuacgacuaaaaggcgucagcuacagccugugcaccgcagcauucaccuucaccaagauacccgccgaaacccuccacggaacagucaccgucgaaguccaauaugcaggaacagacggccccugcaaaguccccgcacaaauggccguggacaugcaaacccuuacaccaguaggaagacucaucacagcaaacccggucaucaccgaaagcacggaaaacucgaagaugaugcucgagcuagacccgcccuucggagauagcuauauaguaauaggaguuggagaaaagaaaauaacccaccacuggcacagaagcggguccacaaucggaaaagcauucgaagcgacaguacgaggggccaaacgaauggcaguccucggagacacagccugggacuucggauccguaggaggagcccuaaacucgcucggcaaaggcauacaccaaaucuucggcgccgcguucaaaucccuauucggaggcaugagcugguucagccaaauacuaauagguacccuacucauguggcucggacugaacaccaaaaacggaagcaucagucuuaugugccuagcacucggaggcguacuaauauuccuaucaacagccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10290 - RNA, 2302 nt, Artificial Sequence
  ZIKV (isolate Z1106033) prME-short variant mRNA Design 1 opt
gggagaaagcuuaccaugggcaaaagguccgccggaagcauaauguggcuggccagccuagcagucgugaucgcaugcgccggcgcgguaacacgccggggcucggcauacuacauguaccucgaccgaaacgacgccggggaagccaucagcuucccgaccacucucgggaugaacaagugcuacauacagauaauggaccuuggacauaccugcgacgcaacaaugagcuacgaaugcccaauguuagacgagggaguagaaccagacgacguggacugcuggugcaacacaacguccaccuggguagucuacggaaccugccaccacaagaaaggcgaggcgcgaagaagccgccgagccgucacacuacccagucacucaacacggaaacuacaaacaagaucacaaacauggcuagagagcagggaauacaccaaacaccucauccgagucgagaacuggauauucagaaacccaggcuucgcccucgccgccgcggcgauagccuggcuacucgggagcuccacaagccagaaaguaauauaccuagugaugauacuccuaauagcgccugcauacucgauccgaugcauuggaguaagcaaccgcgacuucguggaaggcaugucaggcggaaccuggguagacguaguccuagagcacggaggcugcguaaccguaauggcccaggacaaacccacagucgacaucgagcuagucacgacaaccgucagcaacauggcagaaguacguagcuacugcuacgaagcaucaaucucagacauggcaucagacagucgaugccccacacaaggagaagccuaccuagacaaacagucagacacacaauacgucugcaaaaggacccucgucgaccgaggcugggggaacgggugcggauuguucggcaaaggaucccucguuacaugcgcaaaauuugcauguucgaagaaaaugacugggaaaucaauacaaccggaaaaucuggaauacagaaucaugcuauccguacacggcagccagcacagcgguaugaucgucaaugacaccggccacgaaacugacgaaaacagagcaaaagucgaaaucacgcccaacagcccacgggcggaggccacacucggaggcuucggaucacuaggccuagacugcgaaccacgcaccggccuagacuucagugaccuauauuaccugaccaugaacaacaaacacuggcucguacacaaagaaugguuccacgacauaccccuaccguggcacgcgggggccgacaccgggacaccacacuggaacaauaaagaagcccuaguagaguucaaagacgcgcacgccaaacgccaaacagucguaguacucggcucacaagaaggagccguccacaccgcacucgcaggagcucucgaagcagaaauggacggagccaaaggacgacuuagcagcggacaccuaaaaugcagacucaaaauggacaaacucagauuaaaaggagucagcuacucgcuaugcacagcagcauucaccuucacaaagauccccgcggaaacccuacacgggacggucacaguagaaguccaauacgccggcacggacgggccaugcaagguucccgcacaaauggcggucgacaugcagacacugacaccagucggcagacuaauaaccgcgaaccccguaauaacagaaagcacagagaacucgaaaaugaugcuggaacuagacccaccguucggagacucauauauugugaucggaguaggagaaaagaaaauaacacaccacuggcaucgcagcgggagcacaaucggaaaagcauucgaagcuacaguccgcggcgccaaaagaauggcagugcucggcgacacggccugggacuucggaucaguaggcggagcccuaaacucacuuggaaaaggaauacaccaaauauucggcgcagcguucaaaagucucuucggcgggaugucaugguucagccaaauccucaucggcacccuacuaauguggcucggccuaaaugcaaagaacggcagcauaagccucaugugccuagcccuaggaggaguacuaaucuuccuaaguaccgccguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10291 - RNA, 2290 nt, Artificial Sequence
  ZIKV (strain MR 766) prME-short variant mRNA Design 1 opt
gggagaaagcuuaccaugggcaagcgaucagccggauccaucauguggcucgccagccuagcaguagucaucgcaugcgcaggggccaucacaagacgaggcuccgcguauuacauguaccuagaccguagcgacgccggaaaggcaaucagcuucgcaaccacccugggagucaacaaaugucacguacaaaucauggaccuaggacauaugugcgacgcaaccaugagcuacgaaugccccaugcuagacgaaggcgucgaacccgacgacguagacugcuggugcaacacaacuucaacaugggucgucuacggaacaugccaccacaaaaagggcgaagcaagacgcucccguagagccgugacccugccaagccacucaaccagaaaacugcaaacaagaucacaaacauggcuagaaagccgcgaguacacgaaacaccucauaaaaguagaaaacuggaucuuccgcaaccccggguucgcacucguagccgucgcaauagccuggcugcucggcuccagcacaucccagaagguaauauaccuagucaugauccugcucaucgcgccagcauacuccauacgaugcaucggcgucagcaacagagauuucguagagggaaugagcggcggcaccuggguagaugucguccuagaacacggaggcugcgucaccguaauggcacaggacaagcccacaguagacauagagcuagucacgacaacagucagcaacauggcagaaguaagaagcuacugcuaugaagcaucuaucagcgacauggcgagcgacagccgaugccccacgcaaggcgaggccuaccucgacaagcaguccgacacucaauacguaugcaaacgaacccucguagaccgggguuggggaaacggaugcgggcuauucggaaaaggcucccuaguaaccugcgccaaauuuaccugcuccaagaaaaugaccggaaaaucgauccaaccagaaaaccuggaauauagaauaaugcucagcguccacggcagccaacauucuggcaugauaggcuacgaaaccgacgaggacagggcaaaagucgagguaacgccaaacagcccaagggcagaagcgacccucggaggauucggcagccucggacucgauugcgaaccccgcacaggccucgacuucucagaccucuacuaccucacaaugaacaacaaacacuggcucguacacaaggaaugguuccacgacauaccacugcccuggcaugccggcgcugauacaggaacaccacacuggaacaacaaagaagcccucguggaguucaaagacgcccacgcaaaacgccaaaccguaguaguccuaggaagccaagaaggcgcgguacacacagcccucgccggagcccuagaagcagaaauggacggagccaaagguagacuauucucuggacaccucaaaugccgauuaaaaauggacaaacuccgacuaaaggguguaucauauagccuaugcacagcagccuucacauucacaaaggugccagcagaaacgcuucacgggaccgucaccgucgaaguacaguacgccggcacagacggaccgugcaaaauaccaguccagauggcaguagacaugcaaacacucacaccggucggcaggcuaauaacagccaacccaguaauaacagaaagcacagagaacagcaagaugaugcuagaguuagacccgcccuucggggacagcuacauaguaauaggcgucggagacaagaaaauaacacaccacuggcaccgaucaggcagcacgaucggaaaagccuucgaagcaaccguaaggggcgccaaaagaauggcaguacuuggagacacagcaugggacuucggaagcgucggcggaguauucaauaguuuaggcaaaggcauacaccagauauucggagccgccuucaaaucacuauucggagggaugucaugguucagccaaauccucauaggcacccuacucguauggcuaggccucaacaccaaaaauggcuccauaagucugacaugccucgccuuaggcggcguaaugauauuccuaucaaccgccguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10292 - RNA, 2302 nt, Artificial Sequence
  ZIKV (strain NatalRGN) prME-short variant mRNA Design 1 opt
gggagaaagcuuaccaugggaaaacgcucagcgggaucaauaauguggcucgccucccuagcagucgucaucgccugcgccggagccgucacucgccgcggcuccgcauacuacauguaccucgaccgaaacgacgccggagaagccauaucauuccccacaacccucggaaugaacaaaugcuacauccaaaucauggaccuaggccauaugugcgacgcaacgaugucauacgaaugccccaugcucgacgaaggaguagaacccgacgacguagacugcuggugcaacacaacgagcaccugggucgucuacgguaccugccaccacaagaaaggcgaagcccgcagauccagacgagcaguaacucucccaucccacagcacccgcaaacuacagacaaggucgcaaaccuggcucgaaagcagagaauacacaaaacaccucauccgcguagagaacuggaucuuccgaaaucccgguuucgcccuagcagccgcagcaauagcauggcuccucggcucaagcaccagucaaaaaguaauauaccuagucaugauacuccuaauagcacccgcauacagcauaagaugcaucggcguaucgaaccgcgacuucgucgagggaauguccggaggaacguggguugacguaguacuagagcacggcgggugcguaacuguaauggcccaagacaaacccacaguugacauagagcucgucaccacaacggucucaaacauggccgaaguccggaguuacugcuaugaagcgagcaucagcgacauggcauccgacucccgaugccccacacaaggcgaagccuaccuagacaaacagucagacacacaauacgucugcaaacggacacucgucgacagaggauggggcaacggcugcggccucuucggcaaaggcagccuugucaccugugcgaaauuugccugcagcaagaaaaugaccggcaaauccauacaacccgaaaaccuggaauaccgaaucaugcugucaguccacggaucccaacacagcggaaugaucguuaacgacacaggucacgaaaccgacgaaaauagagccaaaguagaaauaacaccgaacagcccccgagccgaagccacacuaggagguuuuggcucccucggccucgacugcgagccacgcaccggacucgauuucucagaccucuacuacuuaacgaugaacaacaaacacuggcucguccacaaagaaugguuccacgacaucccccucccauggcacgcaggagcagacacaggcacaccacacuggaacaacaaggaagcccuagucgaguucaaagacgcccaugccaaacgccaaaccguagucgugcucgguucacaagaaggcgccguccacacggcacucgccggagcacucgaagccgaaauggacggcgcaaagggacgacuauccucaggccaccucaaaugcagacucaaaauggacaaacuaaggcuaaaaggcguaagcuacucccuauguacagcagcauucacauucaccaaaaucccagcagaaacacuucacggcacagucacaguagaaguccaauacgccgggacagacgggccaugcaaagugccggcacagauggccguagacaugcaaacccuaacccccguaggccgucucaucaccgccaacccaguaaucaccgaaagcaccgaaaacuccaaaaugaugcuagaacucgacccacccuucggggacaguuacaucguaaucggaguaggggaaaagaaaaucacccaccacuggcaccgauccggcuccaccaucgggaaggcuuucgaagcaacgguacgcggcgcaaaacggauggcgguacucggagacacagccugggacuucggcagcgucggcggagcccugaacucacuagggaaaggaauacaccaaaucuucggcgccgccuucaaaucgcuauucgggggcaugagcugguucucacaaaucuuaaucggaacccuacucaugugguugggccugaacaccaagaacggauccaucucacugaugugucuagcucucggcgggguacucaucuuccugagcaccgcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10293 - RNA, 2305 nt, Artificial Sequence
  ZIKV (strain ZikaSPH2015) prME-short variant mRNA Design 1 opt
gggagaaagcuuaccauggccaucucaggcguaccaguccuaggguucuucaucaucgccguccucaugagcgcccaagaauccugggccguaacccgccgaggauccgccuacuacauguaccuagacagaaacgacgcaggagaagccaucuccuucccgacaacacucggaaugaacaaaugcuacauacaaaucauggaccucggccacaugugcgacgcaacaaugagcuacgaaugucccaugcuagacgaaggagucgaacccgacgacgucgacugcuggugcaacacuaccagcaccuggguggucuacggaaccugccaccacaaaaagggcgaagcacgacgaaguagacgcgccgucacccuccccagccacucaacacguaaacuacaaacccgaagccagaccuggcucgaaagccgagaauacaccaaacaccucaucagaguagaaaauuggaucuucagaaaccccggguucgcacuggcggcagccgccaucgccuggcuacucggaucuagcacgucccaaaaggucauauaccuggucaugauccuacuuaucgccccagcauacuccauccgcuguauaggcguauccaaccgugacuuugucgaaggcauguccggcggaaccugggucgacauaguccucgaacacggcggaugugucaccguaauggcacaggacaaaccaacagucgacaucgagcuaguaaccaccaccgucuccaauauggcagaaguaagauccuacugcuacgaagccucaaucagcgacauggccucagacagccgaugccccacacaaggcgaagcauaccuagauaagcagucagacacccaguacgucugcaagcgcacccuagucgaccgcggauggggaaacggcugcgggcuauucggaaaaggaagccuaguaaccugcgccaaguucgcuuguucaaagaaaaugaccggaaaauccauacaaccagaaaaccucgaauaccgcaucaugcuauccguacacggcucacaacacagcggcaugauaguaaacgacaccggacacgaaaccgacgaaaaccgggccaaagucgaaauaacaccgaauagcccccgcgccgaagcaacccucggcggauucggaucccucggguuagacugcgagccccgcacuggccucgacuucuccgaccuauacuaccucaccaugaacaacaaacacuggcugguccacaaagagugguuccacgacaucccccugccauggcacgcaggagccgacaccggcacaccccacuggaacaauaaagaagcucuaguagaguucaaggacgcacaugcaaaacgacaaaccgucgucguccuaggcucccaagaaggagcaguacacaccgcccucgcaggagcccucgaagccgaaauggacggagccaaagggcgacucuccucaggacaccuaaaaugucgccuaaaaauggacaagcuaaggcucaaaggaguaagcuacucccucugcaccgcggcauucaccuucacaaaaauccccgcugaaacacuccacggcaccgucacaguggaaguacaauacgccggaacagacgggccgugcaaaguaccagcccaaauggcggucgacaugcagacccucaccccagucgggcgccucaucacggccaacccaguaauuacggaaucaaccgagaacuccaaaaugaugcucgaacuggaucccccauucggcgacagcuacaucgucaucggcguuggcgaaaagaaaauaacacaccacuggcacagauccggcagcacacucggcaaagcguucucuacaacacucaaaggugcacaacgacuagcugcacucggcgacacagcaugggacuucggauccaucggcggagucuucaacuccaucgggagagcaguccaccagguuuucgggggcgccuuccgaacacuauucggagggaugagcuggaucacgcaaggacuaaugggagcccuccuacuauggaugggcguaaaugcaagagaccggagcauagcacucgccuuccuagcaaccggaggcguccucgucuuccuagccacaaacguccacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10294 - RNA, 2305 nt, Artificial Sequence
  ZIKV (isolate Z1106033) prME-short variant mRNA Design 1 opt
gggagaaagcuuaccauggccaucagcggcguccccguccuaggcuuuuucaucauugccguacucaugucagcccaagaaagcugggccguaacccgacgcggcagcgccuacuacauguaccuagaccgaaacgaugcaggggaagcaaucuccuuccccaccacgcuaggaaugaacaaaugcuacauucaaauaauggaccucggccauaccugcgacgccaccaugucauacgagugccccauguuagacgaaggaguagaacccgacgauguggauugcuggugcaacacaacaagcaccugggucguguacgggaccugccaccacaagaaaggagaagcgcgcagaucacgcagggcagucacgcuacccagccacucaacacggaaacugcaaacccgcucccaaacauggcuagagucacgggaauacaccaaacaccugauccgagucgaaaacuggaucuuuagaaacccaggauucgcccucgccgcagcugcuaucgccuggcuccucgggucaucaacaucccagaaaguuaucuaucucguaaugauccuccuaaucgcccccgccuacuccauccgcugcauaggagugaguaacagagacuucguggaaggcauguccggcgggacauggguagacgucguacucgaacacgggggaugcguaacagugauggcucaagauaaaccaacaguagacaucgaacucguuacgacaaccgucagcaacauggcagaaguccgaagcuacugcuacgaggcaagcauaagcgacauggccucagacagccgaugcccuacccaaggcgaagcauaccuagacaaacaaagcgacacccaauacgucugcaaaagaacgcucguggaccguggcuggggaaacggcugcggccuauucggaaaaggaagucugguaaccugcgccaaauucgcgugcuccaagaaaaugaccggcaaauccauccaaccugaaaaccucgaauaccggaucaugcuauccguccacggcagccaacacucaggcaugaucgucaacgacacaggacacgaaaccgacgaaaaucgagccaaaguagaaauaacacccaacagcccaagagcagaagcaacacuaggcggauucgggagccucggacucgacugcgagccacgcacagggcuagacuucucagaccucuacuaccuaaccaugaacaacaaacacuggcucguccacaaagaaugguuccacgacauaccacuccccuggcacgcaggggccgacaccggcacgccacacuggaacaacaaagaggcacuuguagaguucaaagacgcccacgcaaagcgacaaaccgucguaguucucggaucccaagaaggcgccguccacacggcccucgccggagcacuagaagcagaaauggacggcgccaaaggaaggcuaaguuccggccaccucaaauguagacucaaaauggacaaacuucgacuaaaaggagucagcuacagcuuaugcaccgccgcauucacauucacaaaaaucccagcagaaacacuacacggaaccgucacagucgaaguacaauacgcgggcacagacggcccauguaaggugcccgcccaaauggcaguggacaugcaaacccuaacccccguagggcgacucaucacggcaaacccagucaucaccgaaagcacagaaaacagcaaaaugaugcucgaacucgacccaccuuucggggacuccuacauagucaucggcgucggcgaaaagaaaauaacccaccacuggcacagaucaggcaguacccuuggaaaagccuucucaaccacuuuaaaaggugcacaaagacuagcugcacucggcgacaccgcaugggacuucggcucgauaggcgggguauucaacagcauaggacgagcgguccaccaagucuucggcggcgcauuccggacacuguucggaggaauguccuggauaacccagggacucaugggggcccuacuccucuggaugggaguaaacgcgagagaccgcuccaucgcccuagcauuccuagccacaggaggcguccuaguuuuccucgcaacaaacguacaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10295 - RNA, 2293 nt, Artificial Sequence
  ZIKV (strain MR 766) prME-short variant mRNA Design 1 opt
gggagaaagcuuaccauggccaucucagggguaccaguacuaggcuucuucaucauagccguccucaugucagcccaagaaucaugggcgauaacacgccgaggcagcgcuuacuauauguaucucgaucgaagcgacgccggaaaagccaucaguuucgcuaccacucuaggaguuaacaaaugccacguacaaaucauggaucugggccacaugugcgacgccaccaugagcuacgagugcccaaugcucgacgaaggaguagaaccggacgacgucgacugcuggugcaacaccaccaguacauggguugucuacggcacuugccaccacaagaaaggagaagcccgacgaucccgccgcgcggucacucuccccucccacuccacacgaaaacuccaaacccgcucacaaacguggcuagagucgcgagaauacaccaaacaccucauaaaaguagaaaacuggaucuuccgcaacccaggcuucgcacucguagcgguugcgaucgcguggcuccuaggcuccuccacuucccaaaaagucaucuaccuaguuaugauccuccuaaucgccccagccuacagcauccggugcaucggagucucaaacagagacuucgucgaagguaugagcggcggcacauggguagacgugguccucgaacacggcggaugcgucacaguuauggcgcaagacaaacccaccguagacaucgaacucgucacgaccaccgugucaaacauggccgaaguccgaagcuacugcuacgaagcaucaauaucagacauggccuccgacucccguugcccaacgcaaggagaagccuaccucgacaaacaaagcgacacccaauacguuugcaaacgcacccuagucgaccgcggcuggggcaacggaugcggccucuucggaaaaggcucccucgugacaugcgcaaaauucacaugcagcaagaaaaugacaggaaaaucaauccaacccgaaaaccucgaauacagaaucauguugucaguacacggcagccaacacucaggaaugauaggauacgaaacggacgaagaccgcgcaaaagucgaagucaccccaaacagccccagggccgaggcgacccuuggaggauucggcagccucggacucgacugcgagccccgcacaggccucgauuucagcgaucuauacuaccuuaccaugaauaacaaacacugguuaguccacaaagaaugguuccacgacauaccccuccccuggcacgcgggagcggacaccgguaccccacacuggaacaacaaagaagcacucgucgaguucaaagacgcccacgccaaaaggcaaacaguaguaguccucggaagucaagaaggcgccguccacaccgcacuggccggcgcccucgaagccgaaauggauggagccaaaggccgacucuucucaggacaccucaaaugccgacucaaaauggacaaacucagacuaaaaggaguauccuacagccuuugcacagccgccuucacguucacaaaaguccccgccgaaacacuucacggaacggucacagucgaaguacaauacgccggcaccgacggccccugcaaaauccccguucaaauggcgguggacaugcaaacucucacaccuguaggacgacuaauuaccgccaaccccgucaucacugaauccacagaaaacagcaaaaugaugcuagaacucgaucccccauucggcgacagcuacauaguaaucggugucggcgacaagaaaaucacacaccacuggcaccgcagcggcuccacacuuggaaaagcauuuucaaccacccucaaaggcgcacaaagacuagccgcgcucggagacacagcaugggacuucggcucgaucggcggagucuucaacuccauaggacgagccguccaccagguauucggcggagccuuccgcacacuguucggaggcaugagcuggaucacucaaggacucaugggagcgcuccuacucuggaugggcgucaacgcccgcgaccgaagcauagcuuuagccuuccucgccacaggaggcguccucgucuuccucgcgaccaacguacacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10296 - RNA, 2305 nt, Artificial Sequence
  ZIKV (strain NatalRGN) prME-short variant mRNA Design 1 opt
gggagaaagcuuaccauggcgaucuccggcguaccaguccuaggauucuucaucaucgcaguccucaugucugcacaagaaucaugggcaguaacaagacgcggguccgcauacuacauguaccucgaucgaaacgaugccggcgaagccauauccuuccccacaacacuaggcaugaacaaaugcuacauccaaaucauggaccuaggacacaugugcgacgcaacaauguccuacgaaugcccaaugcuggacgaggggguggaaccagacgacguagauuguuggugcaacacaaccuccaccugggugguauacggaacgugccaccacaaaaagggagaagcccgacgcagccgacgagccgugacccuacccucccacagcacacgaaaacuacaaacacgcagccaaacauggcuagaaagcagagaauacaccaaacaccuaauacgcguagaaaacuggaucuuccgcaacccaggcuucgcacuggccgcagccgccaucgcauggcuccucggcagcucaaccucccaaaagguaaucuaccuuguuaugauccuccuaaucgcaccggcguacuccauaagaugcaucggcgucucaaauagggacuucguagaaggcaugagcgggggaacguggguagacguaguccucgaacacggaggcugcguaaccgugauggcacaagacaaaccaacgguagacaucgagcuaguaacaacaaccgucuccaacauggcugaagucagauccuacuguuacgaagccagcauaagugacauggccucagacucacgcugccccacacaaggcgaagcauaccuagacaaacaauccgacacccaguacgucugcaagcgaacccucgucgacagaggcuggggcaacggauguggccuauuuggaaagggaagccucguaaccugcgcuaaauucgccugcucaaagaaaaugacaggcaaaagcauccaacccgaaaaccuggaauaccgcaucaugcuaagcguccacggcagccaacacucagggaugauaguaaaugauaccggacacgaaacagacgaaaaccgagcaaaaguggaaauaacaccaaacucgccacgggccgaagccacgcuagggggcuucggcucacuagggcucgauugcgagccaagaaccggacuagauuucagcgaccuauacuaucuaacgaugaacaacaaacauuggcuaguacacaaagaaugguuccacgacaucccccuaccauggcacgccggcgccgacaccggcacaccacacuggaacaacaaagaagcacucguggaguucaaagaugcccacgccaaaagacaaacagucgugguacuaggcagucaagaaggcgccgugcacacagcucuugcgggagcccuagaagccgaaauggacggcgccaaaggaagacuaagcuccgggcaccucaaaugccgacuaaaaauggacaaacucagacugaaaggcgucagcuacucacucugcacagcagccuucacauucaccaaaauucccgcagaaacacuacacggcacaguaaccgucgaaguccaauacgcaggcacagacggccccugcaaaguccccgcacaaauggccguagacaugcaaacacuaacacccguaggucgacuaauaaccgcgaacccagucaucacagaauccacugaaaacagcaaaaugaugcuagaacucgacccgccauucggagacucauacaucguaaucggagucggagagaagaaaauaacacaccauuggcaccgcucgggcuccacacuaggcaaagccuucagcacaacccucaaaggagcacaaagacuggccgcacucggcgacaccgcgugggacuucggcagcaucggaggcguguucaacucaauaggacgugccguacaccaagucuucggcggagccuuccgaacacuauucggcgggaugucauggauaacccaaggccuaaugggcgcccuacuccuauggaugggaguaaacgcacgggaccgcucgauagcacuagcuuuccucgcaacgggcggcguccuaguguuucuagcaacaaacguucacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10297 - RNA, 2284 nt, Artificial Sequence
  ZIKV (strain ZikaSPH2015) prME-short variant mRNA Design 1 opt
gggagaaagcuuaccauggacuggaccuggauacuauuccucguagccgccgccacccggguccauucagucacccgccgaggcucugccuacuacauguaucuggacagaaacgacgccggcgaagcaauuagcuucccaacaacccucggaaugaacaaaugcuacauacaaauaauggaccucggccacaugugcgacgcaaccaugucauacgagugcccaaugcuggacgagggagucgaacccgacgacguagacugcuggugcaacaccaccagcaccugggucguauacggcacaugucaccacaagaaaggggaagcccgacguagccgcagagcaguaacccuaccaagucauucaacacgcaaacuccaaacaaggagccaaaccuggcuagaaucacgggaguacacaaaacaccucauacgaguagaaaacuggaucuucagaaacccgggguucgcccucgcagccgccgccauagcauggcuucucgggucaagcaccucccaaaaaguaaucuaccucgucaugauacuacuaaucgcaccagcauacagcauacgaugcaucggcguaucaaacagagacuucguagaaggcaugaguggagggaccuggguugacauaguacuggaacacggcggaugcgucacagucauggcacaggacaaaccaaccgucgacauagagcuuguuacaaccacggucagcaacauggccgaaguccgaagcuacugcuacgaggcaagcauaucagacauggccucagacagccgaugcccaacgcagggagaagcauaccucgacaaacaaagcgacacgcaauacgucugcaaaaggacgcuuguagaccgcggcuggggaaacggaugcggccucuuuggaaaaggaucucuaguaaccugcgcaaaguucgcgugcucaaagaaaaugacuggaaaaucaauccaacccgagaaccucgaauaccgcaucaugcuauccguccacgggucacaacacagcggaaugaucguaaacgacacaggacacgaaacagacgaaaacagggccaaaguagagaucaccccgaacagcccaagagccgaagcaacacuaggcggcuucggcagucuuggacucgacugcgaaccgcggacuggacuggacuuuagcgaccuguacuaucucaccaugaacaacaaacacuggcuaguacacaaagaaugguuccacgacaucccgcucccauggcacgcaggcgccgauaccggaaccccucacuggaacaacaaagaagcccucguagaguucaaagacgcccacgccaaacgacaaacaguagucgugcucggaagccaagaaggagcgguacacacggcacucgcgggagcccuggaagcggaaauggacggcgcaaaaggacgacuaucaagcggucaccucaaaugccgacuaaaaauggacaagcuacgccucaaaggcgucagcuauagccuaugcacagccgcauucacauucacaaaaauaccggccgaaacacuacacggcaccgucaccgucgagguacaauacgcagguaccgacggacccugcaaagucccagcccagauggcagucgacaugcaaacccucaccccugucgggaggcuaaucaccgcaaaccccguaauuacagaaucaacagagaacagcaaaaugaugcuggaacuggacccacccuucggcgacuccuacaucgucaucggaguaggugaaaagaaaaucacccaccacuggcaccgaagcggcucaacccuaggcaaagccuucagcacaacccuaaaaggagcccaacgccucgccgcccucggcgauacggcgugggacuucggcuccauaggaggcguauucaauucaaucggccgcgccguacaccaagucuucggcggagcauuccggacacucuucggaggaaugagcuggauaacgcaaggacucaugggcgcauuacucuuauggauggggguaaacgcccgagaccguagcaucgccuuagccuuccucgccacaggcggagugcuaguauuccucgcaacaaacguccacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10298 - RNA, 2284 nt, Artificial Sequence
  ZIKV (isolate Z1106033) prME-short variant mRNA Design 1 opt
gggagaaagcuuaccauggacuggaccuggauacucuuccugguagccgcagcuacccgcguacacucagucacacgccgaggaucggccuacuacauguacuuagaccgcaacgacgcuggcgaagcaauaucauuccccacaaccuuaggcaugaacaaaugcuacauacaaaucauggaccugggccacacaugugacgcgaccauguccuacgagugcccaaugcuggacgaaggaguagagccggacgacguagacugcuggugcaacaccaccagcacauggguagucuacggaaccugccaccacaagaaaggcgaggcccgccgaagccgaagggcagucacccucccaagccacuccacccgaaaacuacagacccgcucccaaaccuggcuagaaucucgugaauacacaaaacaccucaucaggguagaaaacuggaucuuccgcaaccccggcuucgcacucgcagcagccgcaaucgcuuggcuacugggcuccuccaccucacaaaaaguaauauaccuggucaugauccuacugaucgccccagccuacagcauccgcugcaucggcguaagcaaccgggacuucguagaaggcaugucuggcgggaccuggguagacgucgugcuagagcacggcggcugcgucacaguaauggcacaagacaagcccacagucgacaucgaacucgucaccaccaccguaagcaacauggcagagguccgcuccuauugcuacgaggccagcauaucagacauggcaagcgacagccggugcccaacccaaggcgaagcauaccucgauaaacaauccgacacgcaauacguaugcaaacgaacacucgucgacagaggcuggggaaacggaugcggccuauucggaaaaggaucccuagucaccugugccaaauucgccugcaguaagaaaaugacaggcaaaagcauacaaccagaaaaccuagaauaccgaaucaugcucuccguacacggaagccaacacucaggaaugaucgucaacgacacugggcacgaaaccgaugaaaaccgugcaaaaguagaaauaacgcccaacucaccacgcgcagaagccacccugggaggcuucggcagccuaggacucgacugcgaaccaagaacuggccucgacuucucagaccucuacuaccucaccaugaacaacaaacacuggcucguacacaaagagugguuccacgacaucccccuaccauggcacgcuggggcggacacaggcacaccccacuggaacaauaaagaagcccuaguagaguucaaagacgcacacgcaaaacgacaaaccguagucguacuuggcagccaggaaggugcgguccauaccgcacuagccggcgcccucgaagccgaaauggacggcgcuaaaggucgccucucaagcggccaucuaaagugccgacuaaaaauggacaaacuccgucucaaaggagucuccuacagccugugcaccgcagcauucaccuucacaaaaaucccagcggaaacccuccauggaaccgugaccgucgaaguccaauacgcaggaacagauggacccugcaagguccccgcccaaauggcaguagacaugcaaacacugacccccgucggccgacucauaacggccaacccagucauaacugaauccacagaaaacucaaaaaugaugcuggagcucgacccgcccuucggcgauagcuacauagucaucggcgugggcgaaaagaaaauaacucaccacuggcaccgcagcggcaguacacuaggcaaagccuucaguaccacccugaaaggagcccaacgacucgcagcccucggagacacagcaugggacuucgguagcaucggcggcgucuucaacuccaucgggagagccgugcaccaaguguucggaggcgccuuccguacccucuucggaggaaugucauggauaacucaagggcucaugggcgcccuccuacucuggaugggaguaaacgccagagacagaagcaucgcccuagccuuccuagccaccggcggaguacucguauuccuggcaaccaacguccacgcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10299 - RNA, 2272 nt, Artificial Sequence
  ZIKV (strain MR 766) prME-short variant mRNA Design 1 opt
gggagaaagcuuaccauggauuggaccuggauccuguuccucguagccgccgccacacgcguacauucaauaacacgccgaggaucggcauacuacauguacuuggaccguagcgacgcaggcaaagcgaucuccuucgccacaacccugggcgucaauaaaugccacguacaaaucauggaccuuggacacaugugcgacgccacaaugucauacgaaugccccaugcuggacgagggcguagaaccagacgacgucgacugcuggugcaauaccacaagcacaugggucguuuacggcacaugccaccacaagaaaggggaagcgcgacggucccgacgagcggugacacuaccaucccacagcacacgcaaacuacaaacaaggagccaaaccuggcucgaaagccgagaguacacaaaacaccuaauuaaaguagaaaacuggaucuuccgcaauccaggauucgcgcuaguagcagucgccauagccuggcuacuaggaagcagcaccucccagaaagucaucuaucuagucaugauccucuuaauagcacccgcguacaguauacgaugcauaggcguaagcaacagggauuucguagaaggaaugucgggagggaccuggguagacgucgugcucgagcacggcgggugcguaaccguaauggcccaagacaaacccacagucgacaucgaacucguuacaaccacaguuagcaauauggccgaaguaaggucauacugcuacgaagcaucgaucagugacauggcaucagacucacggugccccacgcaaggcgaagcauaccuagacaaacaaagcgacacccaauacgucugcaaacgaacacucgucgaccgaggcuggggaaacgggugcggacucuucggcaaaggcucgcugguaaccugcgcaaaauuuacauguucaaagaaaaugacaggcaaaagcauucaacccgaaaaccucgaguaccgaaucaugcuaucaguccacggaagccaacacagcggaaugaucggguaugaaaccgacgaggacagagccaaaguagaaguaacgccaaacagcccccgggccgaagccacacugggcggauucggaagccucggccuggacugcgaacccagaacaggccuggacuucagcgaccuauacuaccuaaccaugaacaacaaacacuggcucguacacaaagagugguuccacgacaucccccucccauggcacgcaggagccgacaccggcacaccccacuggaacaacaaagaagcccuggucgaguucaaagacgcccacgcgaaacgacagaccguagucgugcuaggaagucaagagggggcaguacacacagcccucgccggagcacucgaggccgagauggacggcgcaaaaggacgccucuucucgggacaccuaaaaugccgccucaaaauggauaaauuaagacuaaaaggcgucucauacucguuaugcaccgccgcauucaccuucaccaaaguccccgccgaaacccuacauggaacaguaaccguggaaguacaguacgcggggaccgacggacccugcaaaaucccaguccagauggcggucgacaugcaaacccugacgcccgucggacgccuaauaacggcuaacccggugauaaccgaauccacagaaaacucaaaaaugaugcucgaacuagacccaccauucggagacagcuacaucguaauaggagucggcgacaagaaaaucacccaccacuggcaccgaaguggauccacacuaggcaaagcauucucaaccacacucaaaggggcccagcggcucgccgcccuaggagacacagcaugggacuucggaucaaucggagguguauucaacucgauaggcagagccguccaccaaguauucggaggggcauuccgaacacuauucgggggaaugagcuggaucacacaaggacucaugggagcccugcugcuuuggaugggcguaaacgccagagaccgaucaauagcccuagcauuccuugcaacaggaggcguccucgucuuccuagcaacaaacguacacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10300 - RNA, 2284 nt, Artificial Sequence
  ZIKV (strain NatalRGN) prME-short variant mRNA Design 1 opt
gggagaaagcuuaccauggacuggacauggauccucuuucucguagcggccgcaacccgaguccacagcgugacccgccgcggcuccgccuacuacauguaccucgacagaaacgacgccggcgaggcaaucuccuucccgaccacccucggaaugaauaaauguuacauacaaaucauggaccucgggcacaugugcgacgcaaccaugagcuacgaaugccccaugcuggacgaaggaguagaaccagacgacgucgauugcuggugcaacaccacaagcaccuggguaguauauggcacaugucaccacaaaaagggggaagcccgccgcucacgccgcgccguaacacucccaucacacagcacccgcaaacuccaaaccagaucccaaaccuggcucgaaucaagagaguacacaaagcaccuaauacgcguagaaaacuggauuuucagaaacccaggcuucgcucuugcagccgccgcgaucgccuggcuccucggcuccaguacaagccagaaggucaucuaccucguaaugauccuccuaaucgcaccagccuacuccauacgcugcauagguguaucaaaccgagacuucguagaaggaaugagcggcggaacaugggucgacguaguacuagaacacggcggcugcgucacagucauggcacaggauaaaccaacggucgacaucgaacucguaaccacaacaguaagcaacauggcagagguccgaagcuacugcuacgaggccuccauauccgacauggcauccgacuccaggugccccacccaaggagaagccuauuuagacaaacaauccgacacccaauacgucugcaaaagaacacugguggaucgaggaugggggaacggcugcggauuauucggaaaaggaucacucguaaccugcgcaaaauucgcaugcagcaagaaaaugacaggcaaaagcauccagccggaaaaccucgaauaccgcaucaugcuaucaguacacggaucccaacacuccggcaugaucgugaacgacacaggacacgaaacggacgaaaaccgggccaaggucgaaauaacaccuaacucaccccgagccgaagcgacucucggaggguucgggagccucggccucgacugcgagccacgcaccggccuagacuuuucagaccucuauuaccucaccaugaacaacaaacacuggcuaguccacaaagaaugguuccacgacaucccacuaccuuggcacgccggcgccgacacaggcacaccccacuggaauaacaaagaagcacuggucgaauuuaaagacgcacacgccaaacgacaaacagucgucguacuaggaucacaagaaggagcaguucacaccgcccuagccggagcacuugaagcagaaauggacggagcaaaaggacgccuuagcucaggacaccuaaagugcaggcugaagauggacaaacugagacucaaaggagucuccuacucacugugcaccgcagccuucacauucacaaagauccccgcagagacucuccacggaaccgucaccgucgaaguacaauacgcaggaacagacggcccuugcaagguccccgcccaaauggcagucgacaugcagacacucaccccagucggaagacucaucacagccaaccccgucauaaccgaauccaccgaaaacucaaaaaugaugcucgaacuggacccacccuucggugacagcuacaucgucauagggguaggagaaaagaaaaucacacaccacuggcaccgcucaggauccacccucggaaaagccuucucaaccacacucaaaggcgcacaaagacucgcggcacucggagacaccgcgugggacuucggauccaucggcggcguauucaacagcauaggacgcgcaguccaccaaguauucggaggagccuuucgaacacucuucggcggaaugucauggaucacccaaggccuaaugggcgcccuacuccucuggaugggagugaacgcccgcgaccggagcaucgcacuagcuuucuuggcaacaggcggcguccuaguauuccuggccaccaacguacacgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10301 - RNA, 2302 nt, Artificial Sequence
  ZIKV (strain ZikaSPH2015) prME-short variant mRNA Design 1 opt
gggagaaagcuuaccaugggcaaaaggucagcgggcagcaucauguggcucgccucccucgcuguagugaucgccugcgcaggagcgguaacgcgccgaggcucagcauacuacauguaucuggaccgaaacgaugccggagaagcaauauccuucccaacaacacuaggcaugaacaaaugcuacauacaaauaauggaccuaggccacaugugcgacgcaacgaugucauacgaaugcccaaugcucgacgaaggcguugaaccagacgacgucgacugcuggugcaacacaacgagcacgugggucguauacggcacaugccaccacaagaaaggagaagcacgccggagccgucgggcagucacccugccaucccacuccacaagaaaacuccaaacacgaagccagacauggcucgagagcagagaauacaccaaacaccuaaucagagucgaaaacuggauauuccgaaaccccggguucgcgcucgcagccgccgcaaucgccuggcuacuaggaucaucaaccagccaaaaaguaaucuaucuaguaaugauacuacuaauagccccggcguacuccauaagaugcauaggcgucaguaaccgagauuucguagaaggaaugucaggagggacaugggucgacaucguacuagagcacggcggcugcgugaccguaauggcacaggacaaaccaacgguagacaucgaacucgucaccacaaccguaaguaacauggcagaagugagaucauauugcuacgaagccuccauaagcgacauggccagcgacucuagauguccaacgcaaggagaagcguaccucgacaaacaguccgacacgcaauacgucugcaaacgcacacucguggaccgcggcuggggaaacggaugcggacuauucggaaaagggucccuagucacaugcgcaaaauuugcgugcucaaagaaaaugacaggcaaauccauccagccagaaaaccuagaauacagaaucaugcucuccguacacggcucccaacacagcggaaugaucguaaacgacacaggacaugaaacggacgagaacagagcaaaagucgaaaucacgcccaauagcccacgcgccgaagcaacccuuggaggcuucggcagcuugggccuugacugcgaaccacgcacggggcuagacuucucagaccuauacuaccuaacaaugaacaacaaacacuggcucguccacaaagagugguuccacgacaucccccucccguggcacgccggcgcagauaccggcacaccccacuggaacaacaaagaagcccuagucgaguucaaagacgcacacgccaaaagacaaacagucgugguacuaggaucccaagaaggagcaguccacacagcgcuagcaggcgcccuagaggccgagauggauggagcgaaaggacgucuauccucaggacaccuaaaaugcaggcuaaaaauggacaaacuacgacuaaaaggcgucucuuacucacuaugcacagccgcauucacauuuaccaaaaucccagcggaaacacugcacggcacaguaaccguagaaguacaauacgcaggcaccgacggacccuguaaggucccagcccaaauggcagucgacaugcaaacacugaccccggucggacgccugauaacagccaacccaguaaucacagaaucgacagaaaauuccaaaaugaugcuagaacuagaucccccauucggcgacagcuauaucgugaucggaguaggggaaaagaaaaucacccaccacuggcaccgauccgggagcacgcucggaaaagcguucucaaccacacugaaaggggcacagcggcucgcagcacucggcgacaccgcaugggacuucgggucaaucggaggcgucuucaacuccaucggacgagcaguacaccaagucuucggaggcgcguucagaacauuauuugggggcaugagcuggaucacacagggccucaugggcgcccuacuccucuggaugggggugaacgccagagacagauccauugcacuagcguuccuagcaacgggcggcguacucguauuccuagccacaaacguccaugccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10302 - RNA, 2302 nt, Artificial Sequence
  ZIKV (isolate Z1106033) prME-short variant mRNA Design 1 opt
gggagaaagcuuaccauggggaaaagaucagcaggcuccaucauguggcucgccucacucgcaguagucauagcaugcgcaggcgcggucaccagacgaggcucagcguacuacauguaccuugacaggaacgacgcaggagaagccaucagcuucccgaccacacucggcaugaacaaauguuacauccaaaucauggaccuaggacauaccugcgacgccacaaugucauacgaaugcccaaugcuagacgaaggcguagaacccgacgacgucgacugcuggugcaacaccacgagcaccugggucgucuacggcacaugccaccacaagaaaggagaagcccgccgaucccgccgagcagucacccuccccagccacucuaccagaaaacuacaaaccagaagccagaccuggcucgaaucaagggaauacacaaaacacuuaaucagggucgaaaacuggauauuccguaacccaggguucgcccucgcggcagccgccauagcauggcuacugggcucgagcacuagccagaaaguaaucuaccucgucaugauauuacugaucgcaccagccuacucaaucagaugcauaggcguaagcaaccgcgacuucguagaagggaugucagguggaacaugggucgacgucguacucgaacacggcgguugcgucacaguaauggcucaggacaagcccacgguagacauagaacuuguaacaacaaccguaagcaacauggccgaaguacgcuccuacugcuacgaagccucaaucucagacauggcauccgacuccagguguccaacgcaaggggaagcguaccuagacaaacaauccgacacacaauacgucugcaaaagaacccuggucgaccgaggcuggggcaacggaugcgggcuauuuggcaaaggcucccuaguaaccugugccaaguucgcaugcuccaagaaaaugaccggcaaauccauacaacccgaaaacuuagaauacagaauaaugcuaucuguucacggaucccaacacagcgggaugauagucaaugacacaggacacgaaacagacgagaacagggccaaaguagaaauaacccccaacagcccacgcgcagaagcuacacugggcggauucggaucucuaggccuagacugcgaaccacgcaccggccuagacuucucagaccucuacuacuugaccaugaauaacaaacacugguuaguccacaaagaaugguuccacgacauaccacuccccuggcacgccggcgcagacacaggcaccccacacuggaacaacaaagaagcccucgucgaguucaaagacgcacacgcgaaacggcagaccgucguaguccucggaagccaagaaggagcgguccacacagcccuagcaggcgcacuagaagcagaaauggacggcgcgaaagggcgacuguccucagggcaccucaaaugucggcucaaaauggacaaacuacgccuuaaaggcguaucguacucacuaugcaccgcggccuucacauucaccaaaauccccgccgaaacacuacauggaaccguaaccgucgaaguacaauacgcaggcaccgaugggcccugcaaagucccugcacaaauggcagucgacaugcaaacacucaccccagucggccgacuaaucacagcuaaccccgugauaacggaguccacagaaaacucgaaaaugaugcucgaacuagacccgcccuucggcgacagcuacauaguuaucggagucggugaaaagaaaauaacccaccacuggcaccgaagcggaagcacccucggaaaagccuucuccaccacccucaaaggcgcccaaagacuagcagccuuaggcgacaccgcgugggacuucggaucuauaggcggaguauucaacuccauaggacgcgcaguccaccaaguauucgggggagcauucagaacacucuucggcgguaugagcuggaucacacaaggccucaugggagcacuccuacucuggaugggcgucaacgcaagggacagauccaucgcccucgcguuucuagcgaccgggggagugcucguauuccucgccacgaacguccacgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10303 - RNA, 2290 nt, Artificial Sequence
  ZIKV (strain MR 766) prME-short variant mRNA Design 1 opt
gggagaaagcuuaccaugggaaaacgcagcgccggauccaucauguggcuagcaucgcucgcaguaguaaucgcgugcgccggugcaaucacacgacgcggcagcgcauacuauauguaccucgaccgaagugaugccgggaaggcgaucucauuugcaaccacgcuaggcguaaauaaaugccacguccagaucauggaccucggccacaugugcgacgccaccaugagcuacgaaugcccgaugcuggacgaaggcguggaacccgaugacgucgacugcuggugcaacacaacaagcaccuggguugucuacggcacgugccaccacaagaaaggcgaagcaagaaggucacgacgagcaguaacgcuaccaagccacagcacacgcaaacuacaaaccagaucacaaacauggcucgagagccgcgaauacaccaaacaccuuauaaaaguagaaaacuggauauucagaaacccgggauucgcccuaguagcaguagcaauagcauggcuacugggcucguccacgagucaaaaaguaauauaccuaguaaugauacuacugauagcacccgccuacucaauccggugcaucggaguauccaacagggacuucguagaagggaugucaggcgggacauggguagacgucguccuagagcacggcggaugcgucacgguaauggcccaagacaaacccacaguagauaucgagcuaguaaccacgaccguaagcaacauggccgaagucagaucguacugcuacgaagccagcaucagcgacauggccuccgacagccgcugcccaacccaaggggaagccuaccuagacaaacaauccgacacacaauacguaugcaaaaggacccuaguagauagaggguggggaaacggauguggucucuucggcaaaggcucccucguaacaugcgccaaauucacaugcagcaaaaagaugacaggcaagucaauacagccagaaaaccucgaguacagaaucaugcucucaguccacgguucacaacacagcggaaugaucggcuacgaaacggaugaagacagagcaaaaguggaaguaacaccuaacagcccacgcgcagaagcgacacuaggaggauucgggagucuaggauuggacugcgaaccaagaacaggccuagacuucagcgaccucuacuaccucacaaugaacaacaaacacuggcuaguccacaaggaaugguuccacgacauaccacuaccauggcacgcgggcgccgacaccggaacaccgcacuggaacaacaaagaagcccucgucgaguucaaagacgcgcacgcaaaacgacaaacgguaguaguccugggcucacaggaaggcgcaguacacacagcgcuagccggagcccuagaggcagaaauggacggcgcaaaaggccgccuguucagcggacaccuaaaaugcagacucaaaauggacaaacuacgccuaaaaggcgugucauacagccucugcacggccgccuuuacguucacaaaagugccagcagaaacacugcacggcacaguuacaguagaaguacaguaugccggaaccgacggcccaugcaaaaucccugugcagauggccguggacaugcaaacacugacaccgguaggacgacuaauaaccgcaaauccagugauaacggaaucaacagaaaacuccaaaaugaugcuggaacucgacccaccauucggcgacagcuacaucgugauaggcguaggagacaagaaaauaacacaccacuggcaccggaguggaagcacgcugggaaaagcauucagcacaacgcucaaaggcgcccagagacucgcggcacucggcgacaccgcaugggacuucggcucaaucggcggggucuuuaacagcaucggacgcgcagugcaccaagucuucggaggcgcguucagaacccucuucggaggcauguccuggauaacccaaggccucaugggcgcacugcuacuauggaugggggucaacgcgagagacagaagcauagccuuagccuuccuggccaccggaggaguacugguauuccuagcaacaaacgugcacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10304 - RNA, 2302 nt, Artificial Sequence
  ZIKV (strain NatalRGN) prME-short variant mRNA Design 1 opt
gggagaaagcuuaccaugggaaaacggagcgcaggcuccauaauguggcuagcaagccuagccgucgugaucgcgugugcaggcgccgucacccggagaggcucggcguacuacauguaccucgaccgaaacgacgcaggagaggcaaucucauuccccacaacacucggaaugaacaaauguuacauccaaauaauggaccuaggccacaugugcgacgcaacaaugagcuacgagugcccaaugcucgacgagggaguagaaccagacgacgucgauugcuggugcaacacaaccagcaccugggucgucuacggaaccugccaccacaagaaaggcgaagcacgccgaagcaggcgcgcagucacucuaccgagucauagcacgcgcaaacuccaaacacgcagccaaaccuggcucgagagcagagaauacacaaagcaccucauccggguagagaacuggaucuucaggaacccaggguucgcccuagccgcagcagcaauagcauggcuccuuggaagcagcaccucacagaaaguaauauaccuaguaaugauucuccucaucgccccagcguacagcauaagaugcaucggagucuccaauagagacuucguagaaggcaugucaggaggcacauggguagacguaguccuagaacacggcggaugcgugaccguaauggcacaagacaaaccaacgguggauauagagcuggucacaaccacaguaagcaacauggcggaaguccggagcuacugcuacgaggcaucaaucagcgacauggcaagcgacagucgaugccccacccaaggcgaagccuaccucgacaaacaaagcgacacgcaauacguaugcaaacgcacacucgucgacaggggguggggaaacggcugcggacucuucggcaaaggcucacucguuaccugcgcaaaauucgcgugcuccaagaaaaugaccggcaaguccauccaaccugaaaaccuggaauaccgaaucaugcuaucgguccacggcagccaacacagcggaaugauagugaacgauacaggucacgaaacagacgagaacagagcaaaaguagaaauaacuccaaacucaccgcgagcagaagccacccugggcggcuucggaagccuaggccucgacugcgaaccccgcaccgggcuagacuuuagcgauuuguacuaccucaccaugaacaacaaacacuggcucguccacaaagaaugguuccacgacauaccccucccauggcacgcgggcgcagacaccggaaccccacacuggaacaacaaagaagccuuaguagaguucaaagacgcacacgcaaagcgacaaaccguagucgugcucggcucccaagaaggagccguacacaccgcacucgccggggcacuggaagcagaaauggacggcgcaaaaggaagacucucaucaggacaccuuaaaugccgacucaaaauggacaaacuaagauuaaagggagucagcuacagucucugcacggcggccuuuaccuucacaaaaauccccgccgaaacacuacacggaacagucaccguggaaguacaauacgcgggaacagauggaccaugcaaagugccagcccaaauggcagucgauaugcaaacccuaacccccguaggacgauugauaacagccaacccagugauaacagaaagcaccgaaaacagcaaaaugaugcuagaacuagaucccccauucggagacagcuacauagucaucgggguaggagaaaagaaaauaacccaccacuggcaccgaagcggcagcacacugggcaaagccuuuucuacgacgcucaaaggagcacaacgacucgcagcucucggagacacagccugggacuucggcaguauaggaggcguauucaacucgauagggagagcaguccaccaaguauucggaggagcauucagaacacuguucggaggcaugagcuggauaacacaaggacuuaugggcgcacuccuacuguggaugggagucaacgcuagagacagaucaauagcccuagccuucuuggccaccggcggaguacucguauuccuugcaacaaacgugcacgcgugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10305 - RNA, 2005 nt, Artificial Sequence
  ZIKV (strain ZikaSPH2015) ME variant mRNA Design 1 opt
gggagaaagcuuaccaugacauccgugggaauagucggacuauuacucaccaccgcaauggccgcagucacccucccaagucacucuacccgcaaacuccaaacccgaucgcagaccuggcucgaaagccgcgaauacacaaaacaccucauccgagucgaaaacuggaucuuccgaaacccaggauucgcccucgccgccgccgcaaucgccuggcuccucgggagcucuacaucacaaaaagucauauaccucguaaugauacuacucauagcccccgccuauuccauccgcuguauaggaguaucaaaccgagacuucguagaaggcaugagcggcggcaccuggguagacaucguacucgaacacggaggcugcguaaccgucauggcacaagacaaacccaccguagacauagaacucgucacaacaaccguaucaaacauggcggaaguccgcuccuacugcuacgaagccucaaucagcgacauggccuccgacucacgcugcccaacacagggcgaggccuaccuagacaaacaaagcgacacccaauacguaugcaaacgcacacucgucgaccgaggcuggggaaacggcugcggccucuucggaaaaggaagccucguaaccugcgccaaauucgccugcuccaagaaaaugacuggaaaauccauacaaccggaaaaccucgaauacagaaucaugcucagcguccacggcucacaacacagcggcaugaucgugaacgacaccggacacgaaaccgacgaaaaccgcgcaaaaguagaaauaacuccaaacucaccacgcgcugaggccacacuaggcggcuucggcucccuagggcucgacugcgaaccaagaaccggucucgacuucucagaccucuacuaccucacaaugaacaacaaacacuggcuuguccacaaagaaugguuccacgacauaccccuccccuggcacgccggcgccgacacaggcacaccccauuggaacaacaaagaagcccucguggaguucaaagacgcgcacgcaaaacggcaaaccguaguagugcuagggucccaagaaggagccguccacacggcccucgcuggagcccucgaagcagaaauggacggcgcuaaaggccgacuguccucaggacaccucaaaugccgccucaaaauggacaaacuacgccucaaagguguuuccuacucacuaugcaccgccgccuucacguucaccaaaaucccagccgaaacccuccacggaacagucaccgucgaagugcaauacgccggcaccgacggccccugcaaagucccagcccaaauggcaguggacaugcaaacccuaaccccagucggccgccuaauuaccgccaaccccgucaucaccgaauccacagaaaacagcaaaaugaugcucgaacucgacccacccuucggcgacucguacaucgugauaggcgucggagaaaagaaaaucacacaccacuggcaccgcagcggcucaacaauaggcaaagcguucgaagccaccguccgcggcgccaaacgcauggccgugcucggcgacacagccugggacuucggauccgucgguggugcccuaaauagcuugggcaagggaauccaccaaaucuucggagccgccuucaaaagccuuuucggagggauguccugguucucccagauccucauaggaacccuacuaauguggcuaggccuaaacacgaagaacggcucaauaagccucaugugccucgcacuaggcggaguacuaaucuuccugucgacugccguauccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10306 - RNA, 2005 nt, Artificial Sequence
  ZIKV (isolate Z1106033) ME variant mRNA Design 1 opt
gggagaaagcuuaccaugaccagcgucggaauagucggccuccuccucacgacagcgauggcagccgugacacuccccucccacucgacaagaaaacuacaaacacgcucccaaacguggcucgaauccagagaguacacuaaacaccugauccgugucgaaaacuggauauuccgcaacccaggcuucgcccuggcagccgccgcaaucgccuggcuacucggcagcagcaccucacaaaaagucaucuaucuaguaaugauacuccugaucgcgccagcuuacuccauccgcugcauaggaguauccaacagagacuucgucgaaggcaugagcggaggcacaugggucgacgucguccuagaacacggaggaugcgucaccguaauggcacaagauaaacccacggucgacaucgagcuaguuaccacaacagucagcaacauggccgaaguccgcaguuacugcuacgaagccagcauaagcgacauggccucagacagcagaugcccaacccaaggcgaagccuaccucgacaaacagucagacacgcaauacguaugcaaaagaacccucguagaucgaggcuggggcaacggauguggacucuucgggaaaggcagccucguaaccugcgccaaauucgcgugcaguaagaaaaugacaggcaaauccauccaaccagaaaaccucgaauaccguauuaugcucuccguccacggcagccagcacuccggcaugaucguaaacgacaccggacacgagaccgacgaaaaccgagccaaagucgaaaucacccccaacucaccccgcgcagaagccacacucggcggcuucggcucccucggacuggacugcgaaccaaggacaggccuagacuucucagaccuauacuaccucacaaugaacaacaaacacuggcucgugcacaaagaaugguuccacgacaucccccuccccuggcacgccggagcagacaccggaacaccccacuggaacaacaaagaggcccuuguagaguucaaagaugcacacgccaagcgccaaaccguaguuguacugggaagccaagaaggcgcaguacacaccgcacuagcaggagcacuagaagccgaaauggacggcgccaaaggccgccuauccagcggccaccuaaaaugccgccucaaaauggacaagcucaggcugaaaggcgucagcuacucccucugcaccgcagcauucaccuucaccaaaauaccugcagaaacccuccacggcaccgucaccgucgaaguacaauacgcaggcacggacggcccaugcaaaguacccgcccaaauggccguggacaugcaaacccucacaccaguaggccgacucaucacagccaauccaguaaucacggaaagcacagaaaacaguaaaaugaugcuagaacucgacccacccuucggagacucuuacaucgucauaggaguaggcgaaaagaaaaucacccaccacuggcaucgcuccggcucaaccaucggcaaagcauucgaagccaccguacgcggcgccaaacguauggcuguccuaggagacaccgcaugggacuucggaucggucggcggcgcccucaacagccuaggaaaaggcauccaccaaaucuuuggagcggcguucaaaucccucuucggaggaaugucgugguucucccaaauacuaaucgguacgcuacuaauguggcucggccucaacgccaaaaacggaucaauuagccucaugugccuagcacuaggcggaguccuaaucuuccuaagcacagcgguaagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10307 - RNA, 1993 nt, Artificial Sequence
  ZIKV (strain MR 766) ME variant mRNA Design 1 opt
gggagaaagcuuaccaugaccuccaucggaauaauuggccuacuacucacaaccgcaauggcggccguaacccuucccucacacuccacucguaaacugcaaacccgcucccagacauggcucgaaucgagagaauacacaaaacaccuaaucaaagucgaaaacuggaucuuccgcaaccccggauucgcccuagucgccgucgcaaucgcauggcuccucggcuccucaaccagccaaaaaguuaucuaccucguaaugauccuccucaucgcacccgcauacucaauacgcugcaucggcgucucuaaccgcgacuuuguagaaggaaugucaggcggcaccugggucgacgucguacucgaacacgggggaugcgucaccgucauggcccaagacaaaccuacagucgacaucgagcuagucacgaccacagucucaaacauggcagagguaagaagcuacugcuacgaagccuccaucuccgauauggccuccgacucccgaugccccacacagggcgaagcauaccuagacaaacaauccgacacccaauacgucugcaaacgcacacucguagaccguggcugggggaacggcugcggacuauucggaaagggcucccucgucacaugcgcgaaauuuaccugcuccaagaaaaugaccggaaaaagcauacagcccgaaaaccucgaauaccgcaucaugcucuccgugcacggcagucaacacucaggcaugauaggcuacgaaacagaugaagaccgcgcaaaggucgaagucaccccaaacucccccagagccgaagccacccucgggggcuucggcagccucggacuagacugcgaaccuagaaccggccuagacuucagcgaccucuacuaccuaacgaugaacaacaaacacuggcuuguacauaaagaaugguuccacgacaucccccugcccuggcacgccggagccgacacaggaacaccgcacuggaacaacaaagaagcacucguugaguucaaagacgcccacgcaaaacgccaaacagucgucguacuaggaagccaagaaggcgccguccacaccgcacuagcaggagcauuagaagccgaaauggacggcgcaaaaggccgccucuucuccggccaccucaaaugccgacuaaaaauggauaaacuccgccucaaaggcgucagcuacucacucugcaccgccgccuucacauucaccaaaguccccgccgaaacacuacacggcaccguaacugucgagguacaauacgccggaacggacggcccuugcaagauacccguacaaauggcaguggacaugcaaacacucacccccgucggcagacuaauaacagccaacccgguaauaaccgaaagcaccgagaacucuaaaaugaugcuagaacucgacccacccuucggcgacagcuacaucgucaucggcgucggcgacaagaagaucacacaccacuggcacagaucagguuccacaaucggcaaggcauucgaagccacgguccgcggcgcaaaacgaauggccguccuaggcgauaccgccugggacuucggcuccgucggaggagucuucaacucccucggaaaaggaauccaccaaaucuuuggagccgccuucaaaucgcuauucggcggcaugagcugguucagccagauccuaauagguacacugcucguauggcucggcuuaaauaccaaaaacggaagcaucucccuaacgugccucgcccucggcggcgucaugaucuuccucuccacagccgugagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10308 - RNA, 2005 nt, Artificial Sequence
  ZIKV (strain NatalRGN) ME variant mRNA Design 1 opt
gggagaaagcuuaccaugacaagcguaggcauagucgggcuccuacuuacaacagccauggcagccguaacauuaccaucacacuccacccgcaaacuacagaccagaucccaaaccuggcucgaaagccgcgaauacacaaaacaccucauacgcgucgaaaacuggaucuucagaaaccccggguuugcccuagcagccgcagcaauagccuggcugcugggaagcuccacaucacaaaaggucaucuaccuaguaaugauccugcucauagccccagccuacuccauccgcugcauaggcgucagcaaccgcgacuucguagaagggaugucaggcgguacauggguagacgucguacucgaacacggaggaugcgucaccguaauggcgcaggacaaaccaacaguagacaucgaacucgucacaaccaccgucucgaacauggccgaagugcgaagcuacugcuaugaagcauccaucucagacauggcguccgacagccgaugccccacccaaggagaggcauaucucgacaaacaaagcgacacccaauaugugugcaaacgcacccucguggaccgcggauggggaaacggaugcggccuguucggaaaaggcucacucguaacaugcgcaaaauucgcaugcagcaagaaaaugaccggaaaaagcauacagccugaaaaccuagaauacagaauaaugcugagcguccacggcucacaacacuccggcaugauaguaaacgacacaggccacgaaaccgacgaaaacagagccaaaguagaaaucacaccaaauuccccacgagcagaagccacacucggcggcuucggcagccuaggccuagacugcgaaccacggacaggacuagacuucagcgaccucuacuaccucacaaugaacaacaaacacuggcugguccacaaagaaugguuccacgauauaccccuccccuggcacgccggagcagacaccggcaccccacacuggaacaacaaagaagcacuggucgaguucaaagacgcucacgcgaaacgccagacagucgucguacugggcagccaagaaggcgccguccacaccgcucucgccggcgcacuagaagcggaaauggacggggcaaaaggccggcuaucaagcggccaccugaaaugccgacucaaaauggacaaacuacgacugaagggcgucagcuacagucuaugcacagccgcauucaccuucacaaaaauccccgcagaaacccuacacggcacagucaccgucgaagugcaauacgccggcacagacggacccugcaaaguccccgcucagauggccgucgacaugcaaacauuaacccccgucggacgacuaauaaccgcaaacccaguaaucaccgaauccacagagaacuccaaaaugaugcucgaacucgaucccccauucggcgacagcuacauaguaaucggcguaggagaaaagaaaauaacgcaccacuggcaccgaagcggcuccaccauaggcaaagcauucgaagcgaccguccgcggagccaaacgcauggcagucuuaggcgacaccgcaugggacuucggcuccgucggcggcgcccuaaacagccucggaaaaggaauccaccaaaucuucggcgccgcauucaaaagccuauucgggggcaugucaugguucucccaaauccugauaggaacccuacucauguggcuagggcugaacaccaaaaacggcagcauaagccuaaugugccuagcacuaggcggaguccucauauuucucucaacagccgucucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10309 - RNA, 2032 nt, Artificial Sequence
  ZIKV (strain ZikaSPH2015) ME variant mRNA Design 1 opt
gggagaaagcuuaccauggccauaucaggcgucccuguccucggcuucuucaucaucgccguacuaauguccgcccaagagucaugggccgcagugacccucccaagccacagcacgcgcaaacuacaaacccgcagccagaccuggcucgaaagccgagaauacaccaaacaccuaauaagagucgagaacuggaucuuccgcaaccccggauucgcgcucgcggccgccgccaucgcauggcuccuaggcagcuccaccucacaaaaagucauauaccucgugaugauccuccuuaucgcccccgccuacuccauccgaugcaucggagucagcaaccgagacuucgucgaaggaaugucaggcggcacaugggucgacauaguccucgaacacggcggaugcgucaccguaauggcccaagacaaacccacagucgacaucgagcuagucacaaccacaguaucaaacauggcagaaguaagaagcuacugcuacgaagccuccaucucagacauggccucggacucacgaugccccacgcagggagaagccuaccuggacaaacagucugacacacaauacgucugcaaaagaacccucguagaccgcggauggggcaacggcugcggacuauucggaaagggcucccuaguaaccugcgcaaaauucgcaugcucgaagaaaaugaccggcaaaucaauucaacccgagaacuuagaauaccgcauaaugcucucaguacacggcucacaacauagcgggaugaucguuaacgacaccggccacgaaacagacgaaaaccgagcgaaagucgaaauaacaccaaacagcccacgcgcggaagccacccugggcggcuucgggucccucggcuuagacugcgaaccgcgaacaggacuagacuuuagugaccucuacuaccucaccaugaacaacaaacacugguuaguacauaaagaaugguuccacgacaucccacugcccuggcacgccggcgccgacaccggcacaccccacuggaacaauaaagaagcccucguagaguucaaagacgcccacgcgaaacgacaaacagucgucguacuaggcagccaagaaggcgcuguccacaccgcucucgccggagcacucgaagccgaaauggauggagcgaaaggacgacuaagcuccggccaccucaagugccgacucaaaauggacaagcuccgccugaaaggcgucaguuacucccuuugcacugcagcauuuaccuuuacgaaaauacccgccgaaacucuacacggaaccgucacaguagaaguccaauacgccggcacagacggaccaugcaaggucccagcccaaauggccgucgacaugcaaacacuuaccccaguaggaagacuaauaacagccaaucccguaaucacagaaucuaccgagaacucaaaaaugaugcucgagcucgaucccccauuuggcgacagcuacaucgucauaggggucggcgaaaagaaaaucacacaccacuggcaccgcagcggcagcacaauaggcaaagcauucgaagccacagucagaggcgcaaaacguauggcgguacugggcgacacagccugggacuucggaaguguaggcggagcacuaaacucguuaggcaaaggcauacaccaaauauucggagcagccuucaaaagccuguucggcggaaugucaugguucucgcaaauccuaaucggcacucuccucaugugguuaggccucaacaccaaaaacgggagcaucagccuaaugugccucgcacucggaggagugcucaucuuccuaagcacggcagucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10310 - RNA, 2032 nt, Artificial Sequence
  ZIKV (isolate Z1106033) ME variant mRNA Design 1 opt
gggagaaagcuuaccauggccaucagcggcguccccguacucggauucuucaucaucgccguacuaauguccgcccaagaaagcugggcagccgugaccuuaccaucacacucaacuagaaaacuccaaacacgcucccaaaccuggcucgaaucuagagaguacaccaaacaccucauccgaguagaaaacuggaucuuccgaaacccaggauucgcacuugccgcagccgcgaucgcauggcugcucggaagcucuaccucacaaaaaguaauauaccuagucaugauucuccuuaucgcccccgcauacagcauacgcugcaucggagucuccaacagagacuucgucgaaggcaugagcggcggcacauggguagacguaguccucgaacacggaggaugcgucaccguaauggcccaagacaaacccaccguagacauagaacuggucacaacaaccgucucaaacauggccgagguaaggagcuacugcuacgaagccuccaucuccgacauggcaagcgacagucgcugcccaacccaaggagaagccuaccuagacaagcaaagugacacccaauacguaugcaaacgaacccucgucgaccgaggauggggaaacgggugcggccuauucggaaaaggaagccucgucacgugcgcaaaauucgcaugcagcaagaaaaugacaggcaaaagcauccaacccgaaaaccucgaguacagaauaaugcuaagcgugcacggcucacaacacuccggcaugaucguaaacgacacaggacacgaaaccgacgagaaccgagccaaagucgaaaucacccccaacucaccacgcgccgaagcaacccucggcggauuugguucccucggacuagacugcgaaccaagaaccggacucgacuucuccgacuuauacuaccuaaccaugaacaacaaacacuggcuaguacauaaagaaugguuccacgacaucccacuacccuggcacgcgggcgcggacaccggcaccccacacuggaacaacaaagaagcacucguagaauuuaaagacgcacacgccaaacgccaaacagugguagugcuaggaucccaggaaggagccguccacaccgcacucgcaggggcccuugaagccgaaauggacggagcgaaaggccgccuuucgagcggacaccucaagugccgccuaaagauggacaaacuccgacucaagggaguaagcuacucccucugcacagcagcauucacauucacaaaaauacccgccgagacacuucacggcaccgucaccgucgaaguccaguaugccggaaccgacggacccugcaaaguaccagcucaaauggccguagacaugcaaacccuaacgcccgucggacgacuaauaacagcgaacccggucaucaccgaaucaaccgaaaacagcaaaaugaugcucgaacuagaucccccauucggagacagcuacauaguaaucggcguaggagaaaagaaaaucacgcaccacuggcaccgcucaggaucaaccauaggaaaagcguucgaagcaaccgugcgcggcgcuaaacgcauggcaguccucggcgacaccgccugggacuuuggaucagucggaggagcccucaacagccucggcaaaggcauacaccaaaucuucggagcagccuuuaaaucccucuucggaggcaugucgugguucagccaaauacuaaucgggacccuacuaauguggcuaggacucaacgccaaaaacggcagcauaucccucaugugccuagcccucggcggaguccucauauuucuaucaacagccgucucagcuugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10311 - RNA, 2020 nt, Artificial Sequence
  ZIKV (strain MR 766) ME variant mRNA Design 1 opt
gggagaaagcuuaccauggcgauauccggagucccaguccucggcuucuucaucaucgcaguccugaugucagcgcaagaaagcugggcagcggucacacuacccagccacuccacacgcaaacuccaaacacgcagccagacauggcuagaaucccgcgaauacacaaaacaccucaucaagguagaaaacuggaucuuccgaaaccccggauucgcgcucgucgcuguagcaaucgcauggcuacucggcagcucgacaucgcaaaaagucaucuaccuagucaugauccuacucaucgcacccgccuacuccauaagaugcaucggcgucuccaaccgagacuucguagaaggaaugucaggcggcaccugggucgacgucguccuagagcacggaggcugcguaaccgucauggcacaggacaaaccaacagucgacauagaacucguaacaaccaccguaucaaacauggccgaaguccguucauacuguuacgaagccucaauaagugacauggccucagacagccgaugccccacccagggggaggcauaccuggacaagcaaucagacacccaauacgucugcaaaagaacgcucguagaccgcggcugggguaacggcugcgggcuauucggcaaaggcucccucgucacgugcgccaaauucacgugcagcaagaaaaugaccggaaaaagcauccaaccugaaaaccucgaauaccgaauaaugcuguccguccacggcagccaacacagcggcaugaucggcuacgaaaccgacgaagaccgcgcaaaagucgaagucacacccaacucaccacgcgcggaagccacacugggaggauucggaagccuaggacuagacugcgaaccacgaacaggacucgacuucagcgaccuuuacuaccucaccaugaacaacaaacacugguuaguccacaaagaaugguuccacgacaucccccuccccuggcacgccggagccgacacaggaacgccccacuggaacaacaaagaagcccucgucgaguucaaagacgcgcacgcaaaaaggcaaaccgucgucguucuaggaucacaagaaggcgcgguacacaccgcgcuagccggcgcccuagaagccgaaauggacggugccaaaggucgccucuucucaggacaccucaaaugccggcugaaaauggacaaacuccgccuaaaaggcguauccuacagccucugcaccgcagccuucaccuucacaaaagucccugccgaaacccugcacggcaccgucaccgucgaaguccaauacgccggaacggauggccccuguaaaauccccguacaaauggccguagacaugcaaacccucacgcccguaggccgacucaucaccgccaacccagucauaacagaauccaccgaaaauagcaagaugaugcuagaacucgaucccccauucggagacucauacauagucaucggagucggcgacaaaaagauaacacaccacuggcaccgcucaggcucaaccaucggcaaagccuucgaagccaccguccgcggcgcaaaaagaauggcaguccucggagacaccgcaugggacuucggcuccguaggaggcguauucaauagccuaggcaagggcauucaccaaauauucggggcagccuucaagagcuuauucggcgggaugucaugguucucccaaauacucaucggaacacuccuaguguggcucggccucaacacaaagaacggcucaaucagccuuaccugccucgcacucggaggcgugaugauauuccuauccacagccguauccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10312 - RNA, 2032 nt, Artificial Sequence
  ZIKV (strain NatalRGN) ME variant mRNA Design 1 opt
gggagaaagcuuaccauggcaauauccggcgugcccguacucggauucuucaucaucgccguccucaugucagcgcaagaauccugggcagccguaacacuccccucccacagcacccgcaaacuacaaacaagaagccaaaccuggcuagaaucacgagaauacaccaagcaccuuauaagagucgaaaacuggauauuccgaaacccaggauucgcacuggcggccgcagcaauagcauggcuccuaggcucgaguacaagccaaaaaguaaucuaccucguaaugauccuacuaaucgcacccgcguacucaaucagaugcaucggcgucagcaacagagacuucguagaaggaauguccggagggacuugggucgacguaguacuagaacacggcggcugcgucacaguaauggcacaagacaaaccaaccgucgacauagagcuagugaccacaaccgucagcaacauggcggaaguacgcagcuacugcuacgaagcaagcauaucggacauggcaagcgacagccgcugcccaacacagggcgaagcauaccuagacaaacaauccgacacccaauacguuugcaagcgaacacucgucgaccgcggcuggggcaacggcugcggccuauucggcaaaggcucccuaguaacaugcgcaaaauucgcaugcucuaagaagaugacaggcaagagcauacaaccagaaaaccucgaauacaggaucaugcuaucgguccacgguucacaacauucaggcaugaucgucaaugacacgggacacgaaaccgacgaaaaccgcgccaagguggaaauaacgcccaacaguccccgcgccgaggcaacccugggcgguuucggcagccucggccucgacugcgaaccaagaaccggacucgacuucagcgaccuauacuaccuaacuaugaacaacaagcacuggcuuguccacaaagagugguuccacgacauaccccuccccuggcacgcaggagcagacaccggaaccccacacuggaacaacaaagaagcacucguagaguucaaagacgcccacgcgaaaagacaaacagucgugguacuggggagccaagaaggugccguccacacagcccuagccggagcacucgaagcagaaauggacggcgcaaaagggcgccucucaucaggccaccuaaagugccgacuaaaaauggacaaacuccgccuaaaaggcguaucuuacucccuaugcaccgccgcauucaccuuuacaaagauaccggccgaaacccuccacggcaccguaacaguagaaguccaauacgccggcaccgacggccccugcaaaguccccgcccaaauggcaguagacaugcaaacacuaacacccgucggccgacucauaaccgccaaccccgucauaacagaaaguacugaaaacuccaaaaugaugcucgaacucgacccacccuucggagacagcuacauagucauaggcgucggcgagaaaaagauaacccaccacuggcaccgcuccggcuccacaauaggcaaggccuucgaagccaccguaagaggcgcaaaacgcauggcaguccugggagacacagcaugggacuucggcuccguuggaggggcacuaaacucacuagggaaaggcauacaucaaauuuucggcgcagccuucaaaagccuauucggcggaaugagcugguucagccaaauacuaaucggcacacuacuuauguggcucggccucaacacgaaaaacggaagcaucucccuaaugugccuagcacucggcggcgugcuaauauuccuaagcacagcagucagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10313 - RNA, 2011 nt, Artificial Sequence
  ZIKV (strain ZikaSPH2015) ME variant mRNA Design 1 opt
gggagaaagcuuaccauggacuggacauggauacuauuccucguagcagcagcgacaagagugcacagugcaguaacccuccccucacacagcacgagaaaacuacagacgcgcagccaaaccuggcucgaaucacgagaauacaccaaacaccuaauacgagucgagaacuggauauucagaaaccccggcuucgcccuagcagcagcagcaaucgccuggcuccuaggcagcagcacaucacaaaaagugauauaccugguaaugauccuucuuauagcccccgccuauaguauaagaugcaucggcgucagcaaucgcgacuucgucgaaggaaugucgggaggaaccugggucgacauaguucuagagcacggaggcugcgucaccguaauggcacaagacaaaccaacaguggacaucgaauuaguuaccacaacgguaagcaacauggccgaagucagaagcuauugcuacgaagcaagcauaucagacauggcaagcgacucccgaugccccacccaaggcgaggcuuaccuagacaaacagagugacacccaguacgugugcaaaagaacccuagucgaccguggcuggggcaacggaugcggacucuucggcaaagggagccucguaacaugcgcaaaauucgcuugcucaaagaaaaugaccggcaaaagcauccaaccagaaaaccuagaauaccgaaucaugcucuccguacacggaucacaacacagcggaaugauagugaacgacaccgggcacgagacagacgagaaccgcgccaaaguagaaauaacccccaacagucccagagccgaagcgacacuaggaggauucggaucauuagggcuggacugcgagccacgaaccggccuagacuucucagaccuauacuaccucacgaugaacaacaaacacuggcucguacacaaggaaugguuccacgacauaccccuaccauggcacgccggcgcagacacaggcacaccccacuggaacaauaaagaagcccucgucgaauuuaaagacgcccacgccaaacgccaaacaguggugguacucggcucacaagaaggugccguucacacggcccuagcaggcgcccuggaagccgaaauggacggagccaaaggucgacuaagcagcggacaucuaaaaugcagacugaaaauggacaaacuccggcucaaaggaguaucauacagccuaugcaccgccgccuucacguucacaaaaauaccagcagagacccuccacggcacagucacgguagaaguccaauacgccggcaccgacggccccugcaaagugccagcacaaauggcagucgacaugcaaacccugacacccgucggcaggcuaaucaccgcaaaccccgucaucacagagaguacagagaacagcaaaaugaugcucgaacucgacccacccuucggagacucguacaucgucauaggcgucggcgaaaagaaaaucacccaucacuggcauagaagcggaagcaccauaggcaaagccuucgaagccaccguacgcggggccaaacgcauggccguccucggagacacagcgugggacuucggcucgguaggcggcgcacucaacucacucggcaaaggcauacaccaaaucuucggcgcagccuucaaaucccuauucggcgggaugagcugguucucgcaaauacuaauaggcacccugcuaauguggcucggacuaaacaccaaaaacggcucgaucucauuaaugugccuagcgcucggcggaguacuaaucuuccuaucaacagcaguaucagccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10314 - RNA, 2011 nt, Artificial Sequence
  ZIKV (isolate Z1106033) ME variant mRNA Design 1 opt
gggagaaagcuuaccauggacuggaccuggauccucuuccucguagccgccgccacacgcguacacagcgcagucacacucccgagccacagcaccagaaaguuacaaacacgcucucaaacguggcuagagucccgagaauacacaaaacaccuaauacgcguagaaaacuggaucuucagaaacccagguuucgcccuggcggcagccgccaucgcguggcuacucggcucaagcaccagccaaaaagucaucuaccucgucaugauccuacucauagccccagccuacuccauccgaugcaucggagucuccaauagagacuucguggagggaaugagcggcgguaccugggucgacguuguccuagaacacggcggcugcgucaccguuauggcccaagacaaacccaccgucgacauagaauuagucaccacaacagucucaaacauggccgaaguccgaagcuacuguuacgaagccuccaucuccgacauggccagcgacucacggugcccgacccaaggcgaggcuuaccucgacaaacaaucagacacacaauacgucugcaaacgcacacucgucgacagaggcuggggcaacggcugcggccuguucggcaaaggcucccuaguuaccugcgcuaaauucgcaugcagcaagaaaaugaccggcaaaagcauccagcccgaaaaccuagaauacagaaucaugcucucaguccacggaagccaacacagcggcaugauagucaacgacaccggccacgaaaccgacgaaaacagagccaaagucgaaaucacccccaacucaccccgcgcggaggccacacuuggcggauucggcucccuaggacuggacugcgaaccccgcaccgggcuagacuucuccgaccuauacuaccucacaaugaacaacaaacacuggcuaguccacaaagaaugguuccacgacauaccauuacccuggcaugccggcgcagacacaggaacaccccacuggaacaacaaagaagcacucgucgaguucaaagacgcccacgccaaacgccaaaccgucgucgugcuaggaucccaagaaggugccguacacaccgcccuugcaggggcucucgaagccgaaauggacggcgccaagggacgccuuuccuccggccaccugaaaugccggcucaaaauggacaaauuacgacucaaggguguaucauacucccucugcaccgcagcauucaccuucaccaaaauccccgccgaaacgcuccauggcaccgucacagucgaaguucaauacgccggcaccgacggacccugcaaggugccggcgcaaauggccgucgacaugcaaacccuaacgcccguagggaggcucaucacugccaacccaguaauaacagaaagcacagaaaacuccaaaaugaugcucgaacucgacccgcccuucggggacucauacauaguaauuggcguaggcgaaaagaaaauaacacaccacuggcacagaagcggaucaacaauaggaaaagccuucgaagcaacgguaagaggggccaaaagaauggccguacucggagacaccgccugggacuucggcucaguugggggugcacuaaacucccucggcaaagguauccaccaaauauucggcgcugcauucaaaucacucuucggaggaaugucaugguucucccagauacucauaggcacccugcucauguggcucggccucaacgcgaaaaacgguagcauuucacuaaugugccucgcauuaggcggagugcucauauuccuaucaaccgcagucagcgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10315 - RNA, 1999 nt, Artificial Sequence
  ZIKV (strain MR 766) ME variant mRNA Design 1 opt
gggagaaagcuuaccauggauuggaccuggauacucuuccuagucgcagcagcaaccagaguacacucagccguuacccuccccagccacucaacaagaaagcugcaaacacgcagccaaacguggcuagaaucccgcgaauacacgaaacaccucauaaaggucgaaaacuggaucuucagaaacccaggcuucgcgcucgucgcggucgccaucgcauggcuacucggguccagcacuucccaaaaagucauauaccuagucaugauccuacucaucgcacccgcuuacagcauccgcugcaucggaguauccaaucgagacuucguagaaggcaugagcggaggcacauggguagacguaguccucgaacacggcggaugcgucaccguaauggcgcaagacaaacccaccguagacaucgaacucguaacaacaaccgucucgaacauggcagaagucagaagcuacugcuacgaagcaagcauaagcgacauggcgagcgacucccgcugccccacccaaggggaagccuaccuggacaaacaaagcgacacccaauacguaugcaaacgaacacucguagauagaggcuggggcaacggaugcggccuauucggaaagggaucccuagucacaugcgcaaaauucacaugcucaaagaaaaugacaggcaaaucaauacaacccgaaaaccucgaauaccgcaucaugcucagcguccacggaucacaacacucgggaaugauaggauacgaaacggacgaagaccgggcaaaaguagaggucacaccaaacuccccaagggcggaagccacccucggcgguuucggcucacuggggcuagacugcgaaccccgcaccggacucgauuucucagaccuauacuaccucacaaugaacaacaaacacuggcucgugcacaaggaaugguuccacgacauaccccucccguggcacgccggcgcggacacaggaacaccccacuggaacaauaaagaagcacucgucgaguucaaagacgcacacgccaaacgccagaccguaguaguacucggaucacaagaaggggccguacacacggcgcuggccggagcacuagaagcagaaauggauggcgcaaaaggccggcuauucaguggacaccuaaaaugucgccuaaaaauggacaaacucagacucaaaggagucuccuacucccuaugcacggccgcguucacauucacaaaaguccccgcagaaacacuccacggcacgguuacagucgaaguccaauacgcaggcaccgacggccccuguaaaauaccuguacaaauggccgucgacaugcaaacacucacacccgucggaagacugaucacugcaaacccagucauaacagaaaguacagaaaacagcaaaaugaugcuagaacuugacccacccuucggcgauucguacaucgucaucggcguaggagacaagaaaaucacccaccacuggcaccgaagcggcagcaccauaggaaaagcauucgaagcaacaguacgcggagccaaaagaauggccguccuuggagacacagccugggacuucggguccgucggaggcguauucaacagccugggaaaaggcauccaccagaucuucggcgcagcauucaaaucgcuauucgguggaauguccugguucagccaaauccuaaucgggacccucuuaguguggcuaggacuaaacacgaaaaacggcagcaucagccuaaccugccuagcccugggaggggucaugaucuuccucucaacugcagucucagcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10316 - RNA, 2011 nt, Artificial Sequence
  ZIKV (strain NatalRGN) ME variant mRNA Design 1 opt
gggagaaagcuuaccauggacuggacguggauacucuuccucguagcagcggccacaagaguccacagcgcaguaacacugcccucacacucuacccgcaaacugcaaacacgcagccaaacauggcuagaaucacgcgaguacacaaaacaccugauccgagucgaaaacuggauauucagaaacccaggauucgcccuggcagcggccgccauagccuggcuacucggaagcucuaccucacaaaagguaauauaccuaguaaugauccuccucaucgcccccgccuacucaauacgcugcaucggaguaagcaaccgcgacuucgucgaaggaaugagcggaggaaccuggguggacgucgucuuagagcacggaggaugugucacgguaauggcccaagacaaacccaccgucgacauagaguuggucaccacaacagucuccaacauggccgaggucagaagcuacuguuacgaagcaaguaucucagacauggccagcgacagccgcugcccaacacaaggagaagcauaccucgacaagcaaagugacacacaauacgugugcaagcgcacgcuaguagaccgaggcuggggaaacggcugcggccucuucggaaaaggcagccucguaacaugcgccaaauucgccugcuccaaaaagaugaccggcaagucgauccaacccgaaaaccucgaauacagaaucaugcuauccguacacggaagccaacacucaggcaugauagucaacgacacuggacacgaaaccgacgaaaaccgcgccaaaguagaaaucacaccaaacucaccacgagcagaagcaaccuuaggaggauucggcucccuaggacucgauugcgagcccagaacagggcuggacuucucagaccuauacuaccuaacaaugaacaacaaacacuggcuaguacacaaagaaugguuucacgacauaccacuaccauggcacgcuggugcagacacgggaacgccccacuggaacaacaaagaagcacucguagaguucaaagacgcacacgcaaagagacaaacaguugucguccuaggaagccaagaaggcgccguacacacggcccucgccggagcucucgaagccgaaauggacggagcuaagggaagacucagcagcggccaccuaaaaugccgacuaaaaauggacaaacuccgacucaagggaguaagcuacucacuaugcacggccgccuucacauucacaaaaauacccgccgagacccuccacggaaccgucaccgucgagguacaguacgcaggaaccgacggacccugcaaaguacccgcgcagauggcaguagacaugcaaacacucacccccgugggacgccucauaaccgcgaacccagucauaaccgaguccacggaaaacagcaaaaugaugcuagaacuugacccaccauucggagacuccuacaucguaauaggcgucggcgaaaagaaaaucacacaccacuggcaccgaucaggcucgaccaucggaaaagccuucgaagcaacaguacgcggcgccaaacgcauggcaguccucggagacacggccugggacuucggcucaguagggggcgcacucaacagucuaggaaaaggcauacaccagaucuuuggggcagccuucaaaagccuauucggcggaaugagcugguucagccaaaucuuaaucggaacacuacuaauguggcucggccuaaacaccaaaaacggauccaucagccuuaugugccuugccuuaggaggcgugcuaauauuccugagcacagcuguaagcgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10317 - RNA, 2029 nt, Artificial Sequence
  ZIKV (strain ZikaSPH2015) ME variant mRNA Design 1 opt
gggagaaagcuuaccauggguaaaagauccgccggcagcauaauguggcuggccucccucgccgucgugauagcaugcgcaggcgccgcagucacacuccccagccacagcaccagaaaacuacaaacccgcucccaaaccuggcuagaaucaagagaauauacaaaacaccucauaagagucgaaaacuggauauuccgaaaccccggcuucgcacucgccgccgcagcaauagccuggcuccucggcucuagcacgucacaaaaggucauauaucuagucaugaucuugcuaaucgccccagcauacuccauccggugcauaggcguuuccaaucgggacuucguagaaggcauguccggcggaaccugggucgauauaguccuagaacauggcggaugcgucacagucauggcacaagacaaacccaccguagacauagagcuagucaccacgaccgugagcaacauggccgaagucagaucauacugcuacgaagcaucaaucucggacauggcauccgacagccgcugucccacacagggagaagccuaccuagacaaacaauccgacacacaauacgucugcaaacgaacccuaguagaccgcgguuggggaaacggaugcggccucuucggcaaaggaagccuggucacaugcgcaaaauucgccugcagcaagaagaugaccggcaaaagcauccaaccugaaaaccucgaauaccgcaucaugcuuuccguacacggcagucaacacuccggaaugaucgucaacgacacagggcacgaaaccgacgaaaaccgcgccaaagucgaaaucacacccaacagcccccgagccgaagccacccucggcggcuucggcucccucggacuagacugcgagcccaggacgggccucgacuucuccgaccuauacuaccucacaaugaacaacaaacacuggcuaguccacaaagaaugguuccacgacaucccccuccccuggcacgcaggcgccgacacaggcacaccacacuggaacaacaaggaagcacucguagaguucaaagacgcccacgcaaaacgccaaacaguaguaguacugggaucccaagaaggagccgugcacaccgcacuagcaggcgcacucgaagccgaaauggacggagcgaagggccgacuaucguccggacaccuuaaaugcaggcugaagauggacaaacucagacuaaaaggaguauccuacucccuaugcacagccgcauucacauucaccaaaauacccgcagaaacccuacacggaaccgucacagucgaaguccaauacgccggaaccgacggccccugcaaaguccccgcgcaaauggccguagacaugcaaacucucacccccguuggaagacucaucaccgccaacccggucaucacggaaaguaccgaaaacuccaaaaugaugcucgagcuagacccacccuucggagauuccuacauagucaucggcguaggagaaaagaaaauaacacaucacuggcacagauccggcuccaccauaggcaaagccuucgaagccaccguacgcggggcuaaacgcauggccguccucggcgacacagcaugggacuucggauccguaggcggagcccucaacucacugggcaaagggauucaccaaaucuucggcgccgccuucaaaagccuauucggcggaaugagcugguucucccaaauccuaauuggcacccuacuaauguggcucggccucaacacgaaaaacggcagcaucagccuuaugugcuuagcccucggaggcguccucaucuuccucuccacagccgucuccgcaugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10318 - RNA, 2029 nt, Artificial Sequence
  ZIKV (isolate Z1106033) ME variant mRNA Design 1 opt
gggagaaagcuuaccauggggaaacgaagcgcaggcuccaucauguggcucgccucacuagcagucgucauagcaugcgcaggcgcagccguaacccucccuucccacucaacaagaaaacuacaaaccagaucacaaacguggcuagaaucgcgagaauacacgaaacaccucaucagagucgaaaacuggauauuuaggaaccccggcuucgcccuagcagcagccgcaaucgcguggcugcugggcagcucaacaucgcaaaaagugauauaccuaguaaugauccuccuaauagccccggcauacagcauacgcugcaucggaguaucaaaccgagacuuugucgaggguauguccggcggaacauggguagacgugguucucgaacacggcggcugcguaaccguaauggcacaagacaaaccaaccguggacaucgaacucgucacaacaaccguaagcaacauggccgagguacgauccuacugcuacgaagccagcauuucagacauggcaagcgacuccagaugcccaacccagggcgaagccuaccucgacaaacaaagcgacacacaauacguaugcaaacgaacacucguggaccgaggcuggggaaacggcugcggacuguucggaaaaggaagccuagugaccugcgcgaaauucgccugcuccaagaaaaugacaggaaaaucaauccagccugaaaaccucgaguaccgaauaaugcucagcguccauggaagccagcacuccggcaugauaguaaacgacacaggacacgaaacggacgaaaacagagcaaaaguagaaaucaccccaaacucacccagagccgaagcaacacuuggaggcuucggcucacucggacuagacugcgagccacgcaccggacucgacuucagcgaccucuacuaccuaaccaugaacaacaaacacuggcuuguacacaaagaaugguuccacgacauaccccucccuuggcacgcaggagcagacaccggaacaccccacuggaacaacaaagaagcacugguagaguucaaagacgcacacgcaaaacgacaaaccguagucgugcugggcagucaagaaggcgccgugcacaccgcccucgcuggagcccuugaagcagaaauggacggggccaaaggcagacucucauccggccaccucaaaugccgacucaaaauggacaaacuuagacuaaaaggcguaagcuacagccugugcacggcggcauucacauucacgaaaauaccagccgagacccuacacggcacugucaccguagaaguacaguacgcaggcacagacgggcccugcaaaguacccgcacaaauggccguugacaugcaaacccuaaccccagucggccgccucaucaccgccaaccccguaauaacagaaagcacagaaaacagcaaaaugaugcucgaacucgacccaccguucggagacagcuacaucguaaucggcgugggcgaaaagaaaauaacgcaucacuggcaccgaucaggaucaaccaucggcaaagccuucgaagcaaccguucgcggcgcaaaaagaauggccguacuaggcgacacggcaugggauuucgguagcguagggggcgcccuaaacucccuaggcaaaggcauccaccaaaucuucggcgccgcauucaaaucacuauucggcggaaugagcugguucagccaaauccucaucggcacccuccucaugugguuaggacugaaugccaaaaacggaagcaucucacucaugugccuagcccugggaggaguauuaaucuuccuaucuacagcaguaucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10319 - RNA, 2017 nt, Artificial Sequence
  ZIKV (strain MR 766) ME variant mRNA Design 1 opt
gggagaaagcuuaccaugggcaaaagaucagccggaucaaucauguggcuugcaagccucgcuguaguaaucgccugcgcuggagcagcagucacccuccccucacacuccaccagaaaacuacaaacacgcucccaaacauggcucgaaucacgagaauacaccaaacaccucaucaaggucgaaaacuggaucuuccgaaaccccggauucgcacucguagcaguagccaucgcauggcuacucggauccucaaccagccagaaaguaauauaccuagucaugauccuccugauagcacccgccuacagcauccgaugcaucggcgucagcaaccgagacuucgucgaaggcaugucagggggaaccugggucgacgucguccuagagcacggcggcugcguaacagucauggcacaagacaagcccaccgucgacauagaacuggucacaacuaccguauccaacauggccgagguaagauccuacugcuacgaagccagcauaagcgacauggccagcgacaguaggugcccuacacaaggcgaagccuaccucgauaaacaaucagacacccaauaugucuguaaacgcacucuaguagacagaggauggggcaacggcugcggccuauuuggcaaaggcagccuagucacaugcgcaaaguuuaccugcagcaagaaaaugaccggaaaaucaauccaaccagaaaaccucgaauaccgaaucaugcucucaguacacggaucgcaacacucaggcaugaucggcuaugaaaccgacgaagaccgugccaaaguagaaguaaccccaaacagcccacgagcugaagcaacccuaggaggcuucggaucccucgggcucgacugcgaaccaagaaccggccuagacuucuccgaccuguacuaccucacgaugaacaacaaacacuggcucguacacaaggaaugguuccacgacauaccgcuacccuggcacgcaggcgcagacacaggcacgccacacuggaacaacaaagaagcccuaguggaguucaaagacgcacacgcaaaacgccagaccguggucguccuagggagccaagaaggagccguacacacagcccuggccggcgcccuugaagccgaaauggacggcgcaaaaggccgacucuucagcggacaccucaaaugccgucucaaaauggacaaacuacggcucaaaggcguauccuauucacucugcaccgccgccuucacauucacaaaggucccugcggaaacucuacacggaacagucacagucgaagugcaauacgcaggaaccgacggcccuugcaagauaccaguccagauggccgucgacaugcaaacccucacgccagucggccgacucaucaccgcaaaccccguaaucacagaaucaacggaaaacucaaagaugaugcucgagcucgacccucccuucggagacucauacauagucaucggggucggcgacaagaaaauaacccaccacuggcacagaagcggcuccaccaucggaaaagccuucgaagcgacaguccgaggcgcaaaacgcauggccguacucggagacaccgcgugggacuuuggcucaguaggcggcguguuuaacagccucggaaaaggaauccaccaaauauucggagcagcguucaaaucacuguucggcgggauguccugguucucccaaauccucaucggaacacuucucguauggcuaggccuaaacaccaaaaacggaucaaucucacuaacaugccucgcccucggaggagucaugauauuccugucgacugcggucucggccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10320 - RNA, 2029 nt, Artificial Sequence
  ZIKV (strain NatalRGN) ME variant mRNA Design 1 opt
gggagaaagcuuaccaugggaaagcgauccgcaggauccauaauguggcucgccucccuagccgucguaauagcgugcgccggcgcagccguaacccuacccucccacagcacccgcaagcuacaaacacgcucacaaaccuggcuugaaucacgcgaguacacuaaacaccuaauacgcguagaaaacuggaucuuccguaaccccggguucgcacucgccgcagccgccaucgccuggcuucuaggaagcuccacaucacaaaaagucaucuaccuagucaugauccuccucauugccccagccuacaguaucagaugcaucggugucuccaaccgggacuucgucgaagggauguccggaggaacauggguagacgucguccucgaacacggcggcugcguaaccguaauggcgcaggacaaaccgacugucgacauagagcuaguaaccacuaccgucuccaacauggcagaaguacgauccuacugcuacgaagccagcauuagcgacauggcauccgacagccgcugccccacccaaggcgaagccuaccucgacaaacaaucagacacccaauacgucugcaaacgcacacucgucgaccguggcuggggcaacggcugcggacucuucggaaagggcucccuaguuaccugcgcaaaguucgccuguuccaagaaaaugaccggcaaaucgauacaaccagaaaaccucgaauaucgaauaaugcucuccguccacggcagccaacacagcggcaugauaguaaacgacaccggacacgaaacagacgaaaaccgcgcuaaagucgaaauaacacccaacucaccccgggccgaagccacccucggcggcuucggaucacucggccucgacugcgagcccagaaccggccuagacuucucggaccucuacuaucuaacaaugaacaacaaacacuggcucguccacaaagaaugguuccacgacaucccacuccccuggcacgccggagccgacaccggaacaccucacuggaacaacaaagaagcccucgucgaguucaaagacgcccacgccaaacgccagacagugguaguacuaggcagccaagaaggagccguccacacggcccuagcaggagcccuggaagccgaaauggacggagcaaaaggcagacucucuagcggccaccucaagugccgccuaaaaauggacaaacuacgacuaaaaggcguuuccuacagccugugcaccgccgccuucacguucacuaaaauacccgccgaaacccuccacggcaccguaacagucgaaguccaauacgcaggaaccgacggaccgugcaaaguaccugcacaaauggccguagacaugcagacccugaccccaguaggcagacuaaucacagccaaccccguaauaacggaaucaaccgaaaacucaaaaaugaugcuugaacuagacccgcccuucggggacaguuacaucguaaucggcgucggagaaaagaaaauaacccaccacuggcacagauccggaucaaccaucggaaaggccuucgaagcaaccguccggggagccaaacgcauggccguccuaggagacacagccugggacuucggcagugucggcggcgcccucaacagucugggaaaaggcauacaccaaaucuucggcgcagcauucaagagccuauucgggggaaugagcugguucucccaaauacuaauaggaacccuccuaauguggcugggacucaacaccaaaaacggcagcaucucacucaugugccucgcccucggcggaguacugauauuccucucuacagcagucuccgccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10321 - RNA, 2470 nt, Artificial Sequence
  ZIKV (strain ZikaSPH2015) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10322 - RNA, 2470 nt, Artificial Sequence
  ZIKV (isolate Z1106033) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10323 - RNA, 2458 nt, Artificial Sequence
  ZIKV (strain MR 766) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10324 - RNA, 2470 nt, Artificial Sequence
  ZIKV (strain NatalRGN) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10325 - RNA, 2449 nt, Artificial Sequence
  ZIKV (strain ZikaSPH2015) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10326 - RNA, 2449 nt, Artificial Sequence
  ZIKV (isolate Z1106033) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10327 - RNA, 2437 nt, Artificial Sequence
  ZIKV (strain MR 766) prME-short variant mRNA Design 2 wild type
ggggcgcugccuacggagguggcagccaucuccuucucggcaucaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10328 - RNA, 2449 nt, Artificial Sequence
  ZIKV (strain NatalRGN) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10329 - RNA, 2467 nt, Artificial Sequence
  ZIKV (strain ZikaSPH2015) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10330 - RNA, 2467 nt, Artificial Sequence
  ZIKV (isolate Z1106033) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10331 - RNA, 2455 nt, Artificial Sequence
  ZIKV (strain MR 766) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10332 - RNA, 2467 nt, Artificial Sequence
  ZIKV (strain NatalRGN) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10333 - RNA, 2470 nt, Artificial Sequence
  ZIKV (strain ZikaSPH2015) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10334 - RNA, 2470 nt, Artificial Sequence
  ZIKV (isolate Z1106033) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10335 - RNA, 2458 nt, Artificial Sequence
  ZIKV (strain MR 766) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10336 - RNA, 2470 nt, Artificial Sequence
  ZIKV (strain NatalRGN) prME-short variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10337 - RNA, 2449 nt, Artificial Sequence
  ZIKV (strain ZikaSPH2015) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10338 - RNA, 2449 nt, Artificial Sequence
  ZIKV (isolate Z1106033) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10339 - RNA, 2437 nt, Artificial Sequence
  ZIKV (strain MR 766) prME-short variant mRNA Design 2 wild type
ggggcgcugccuacggagguggcagccaucuccuucucggcaucaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10340 - RNA, 2449 nt, Artificial Sequence
  ZIKV (strain NatalRGN) prME-short variant mRNA Design 2 wild type
ggggcgcugccuacggagguggcagccaucuccuucucggcaucaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10341 - RNA, 2467 nt, Artificial Sequence
  ZIKV (strain ZikaSPH2015) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10342 - RNA, 2467 nt, Artificial Sequence
  ZIKV (isolate Z1106033) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10343 - RNA, 2455 nt, Artificial Sequence
  ZIKV (strain MR 766) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10344 - RNA, 2467 nt, Artificial Sequence
  ZIKV (strain NatalRGN) prME-short variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10345 - RNA, 2170 nt, Artificial Sequence
  ZIKV (strain ZikaSPH2015) ME variant mRNA Design 2 wild type
ggggcgcugccuacggagguggcagccaucuccuucucggcaucaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10346 - RNA, 2170 nt, Artificial Sequence
  ZIKV (isolate Z1106033) ME variant mRNA Design 2 wild type
ggggcgcugccuacggagguggcagccaucuccuucucggcaucaagcuuaccaugacgagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10347 - RNA, 2158 nt, Artificial Sequence
  ZIKV (strain MR 766) ME variant mRNA Design 2 wild type
ggggcgcugccuacggagguggcagccaucuccuucucggcaucaagcuuaccaugaccagcaucggaaucauuggccuccugcugacuacagccauggcagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10348 - RNA, 2170 nt, Artificial Sequence
  ZIKV (strain NatalRGN) ME variant mRNA Design 2 wild type
ggggcgcugccuacggagguggcagccaucuccuucucggcaucaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10349 - RNA, 2197 nt, Artificial Sequence
  ZIKV (strain ZikaSPH2015) ME variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10350 - RNA, 2197 nt, Artificial Sequence
  ZIKV (isolate Z1106033) ME variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10351 - RNA, 2185 nt, Artificial Sequence
  ZIKV (strain MR 766) ME variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10352 - RNA, 2197 nt, Artificial Sequence
  ZIKV (strain NatalRGN) ME variant mRNA Design 2 wild type
ggggcgcugccuacggagguggcagccaucuccuucucggcaucaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10353 - RNA, 2176 nt, Artificial Sequence
  ZIKV (strain ZikaSPH2015) ME variant mRNA Design 2 wild type
ggggcgcugccuacggagguggcagccaucuccuucucggcaucaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10354 - RNA, 2176 nt, Artificial Sequence
  ZIKV (isolate Z1106033) ME variant mRNA Design 2 wild type
ggggcgcugccuacggagguggcagccaucuccuucucggcaucaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10355 - RNA, 2164 nt, Artificial Sequence
  ZIKV (strain MR 766) ME variant mRNA Design 2 wild type
ggggcgcugccuacggagguggcagccaucuccuucucggcaucaagcuuaccauggacuggaccuggauccuguuccucguggccgccgcgacccgcguccacagcgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10356 - RNA, 2176 nt, Artificial Sequence
  ZIKV (strain NatalRGN) ME variant mRNA Design 2 wild type
ggggcgcugccuacggagguggcagccaucuccuucucggcaucaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10357 - RNA, 2194 nt, Artificial Sequence
  ZIKV (strain ZikaSPH2015) ME variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10358 - RNA, 2194 nt, Artificial Sequence
  ZIKV (isolate Z1106033) ME variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10359 - RNA, 2182 nt, Artificial Sequence
  ZIKV (strain MR 766) ME variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10360 - RNA, 2194 nt, Artificial Sequence
  ZIKV (strain NatalRGN) ME variant mRNA Design 2 wild type
ggggcgcugccuacggagguggcagccaucuccuucucggcaucaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10361 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10362 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10363 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10364 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10365 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10366 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10367 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10368 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10369 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10370 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10371 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10372 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10373 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10374 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10375 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10376 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10377 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10378 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10379 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10380 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10381 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10382 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10383 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10384 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10385 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10386 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccagcguggggaucgugggccuccugcugacgaccgccauggcggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10387 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccagcaucgggaucaucggccugcugcucacgaccgccauggcggccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10388 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10389 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10390 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10391 - RNA, 2185 nt, Artificial Sequence
  ZIKV (strain MR 766) ME variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10392 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10393 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10394 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccuguuccucguggccgccgcgacccgcguccacagcgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10395 - RNA, 2164 nt, Artificial Sequence
  ZIKV (strain MR 766) ME variant mRNA Design 2 opt
ggggcgcugccuacggagguggcagccaucuccuucucggcaucaagcuuaccauggacuggaccuggauccuguuccucguggccgccgcgacccgcguccacagcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10396 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10397 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10398 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10399 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10400 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10401 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10402 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10403 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10404 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10405 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10406 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10407 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10408 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10409 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10410 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10411 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10412 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10413 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10414 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10415 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10416 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10417 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10418 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10419 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10420 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10421 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10422 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10423 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10424 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10425 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10426 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10427 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccuccaucggcaucaucggccuccuccucaccaccgccauggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10428 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10429 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10430 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10431 - RNA, 2185 nt, Artificial Sequence
  ZIKV (strain MR 766) ME variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10432 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10433 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10434 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10435 - RNA, 2164 nt, Artificial Sequence
  ZIKV (strain MR 766) ME variant mRNA Design 2 opt
ggggcgcugccuacggagguggcagccaucuccuucucggcaucaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10436 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10437 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10438 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10439 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10440 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10441 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgaucggaaaggccuucgaagcuaccgugcgcggugccaaaagaauggcaguacuaggcgauacugcuugggacuuuggguccgugggaggcgcccucaauucucuggguaaggggauucaccaaaucuucggcgcggccuuuaaaucgcuuuucggaggcaugagcugguuuucccagauuuugauagggacacugcucauguggcugggacuuaacaccaagaauggcucaaucagucugauguguuuggcucucggugggguucugauuuucuuaucuacagcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10442 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcaccaucggaaaggccuucgaagcuacuguacgcggugccaaaagaauggcagugcuaggcgauacagcuugggacuuuggguccguuggaggcgcccucaauucucuggguaaggggauccaccaaauuuucggcgcggccuuuaaaucgcuuuucggaggcaugagcugguuuucccagaucuugauugggacccugcucauguggcugggacuuaacgcuaagaauggcucaauaagucugauguguuuggcacucggugggguccugaucuucuuaucuacagccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10443 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgauuggaaaggcuuuugaggccaccgugcggggugcaaaacgcauggccgugcuaggcgacacugcuugggauuucggguccgucggaggcguuuuuaauucucucgguaaggggauccaccaaaucuucggcgccgcauuuaaaucgcuguucggaggcaugagcugguuuucccagauucuuaucgggacauugcugguguggcucggacugaacaccaagaacggcucaauuagucuuacaugucuggcuuuggguggggugaugauauuccucucuacugccguaagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10444 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgaucggaaaggccuucgaagcuaccguacgcggugccaaaagaauggcagugcuaggcgauacugcuugggacuuuggguccguuggaggcgcccucaauucucuggguaaggggauccaccaaauuuucggcgcggccuuuaaaucgcuuuucggaggcaugagcugguuuucccagaucuugauugggacacugcucauguggcugggacuuaacaccaagaauggcucaauaagucugauguguuuggcucucggugggguccugaucuucuuaucuacagcagugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10445 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacuauuggcaaggcauucgaggccacagucagaggggcuaaaaggauggccgugcuaggagacaccgcaugggauuucgguaguguaggcggggcucucaauagccugggaaagggcauccaucagaucuuuggugccgcguucaaaucccuuuuugggggcaugucuugguucucgcaaauuuugaucggaacacugcucauguggcugggccuuaacacuaagaaugggagcauuucccugauguguuuggcccucggaggcgugcugauauuuuuaucaaccgcuguuagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10446 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacaauaggcaaggcauucgaggccaccgugagaggggcuaaaaggauggccguacuaggagacacagcaugggauuucgguagugugggcggggcucucaauagccugggaaagggcauucaucagaucuuuggugccgcguucaaaucccuuuuugggggcaugucuugguucucgcaaaucuugauuggaacucugcucauguggcugggccuuaacgccaagaaugggagcaucucccugauguguuuggcucucggaggcguucugaucuuuuuaucaaccgcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10447 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacuaucggcaaggcguucgaagcuacaguccgcggggccaaaagaauggcagugcuaggagauaccgccugggacuuugguagugugggcggggucuucaauagccucggaaagggcauacaucagauuuuuggugcugccuucaaaucccuguuugggggcaugucuugguucucgcaaauccuuaucggaacauugcugguuuggcucggccugaacacuaagaacgggagcauuucccuuaccugucuggcauugggaggcgugaugaucuuucucucaacggcugugagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10448 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacuauaggcaaggcauucgaggccacagugagaggggcuaaaaggauggccguacuaggagacaccgcaugggauuucgguagugugggcggggcucucaauagccugggaaagggcauucaucagaucuuuggugccgcguucaaaucccuuuuugggggcaugucuugguucucgcaaaucuugauuggaacacugcucauguggcugggccuuaacacuaagaaugggagcaucucccugauguguuuggcccucggaggcguucugaucuuuuuaucaaccgcugucagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10449 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgaucgguaaagccuuugaggcaaccgucagaggcgcuaagaggauggccgugcuaggggauacugcgugggacuucggauccguaggcggugcccucaauucucuggggaaaggcauccaccagauuuucggagcugcauuuaagucgcuuuucggcgggaugagcugguuuucccaaaucuugauuggaacacugcucauguggcugggccuuaacaccaaaaaugguucaauaagucugaugugcuuggcccucgggggagugcugaucuucuuaucuacagcuguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10450 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcaccauugguaaagccuuugaggcaacugugagaggcgcuaagaggauggccguacuaggggauacagcgugggacuucggauccgugggcggugcccucaauucucuggggaaaggcauccaccagaucuucggagcugcauuuaagucgcuuuucggcgggaugagcugguuuucccaaauuuugaucggaacccugcucauguggcugggccuuaacgccaaaaaugguucaauuagucugaugugcuuggcucucgggggaguucugauauucuuaucuacagccgucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10451 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcugggaggguucggcucccuuggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgauagguaaagcauucgaagccaccguccgcggcgcuaagagaauggccgugcuaggggacacugcaugggauuucggauccgugggcggugucuuuaauucucucgggaaaggcauucaccagaucuucggagcugccuuuaagucgcuguucggcgggaugagcugguuuucccaaauccuuauuggaacauugcugguuuggcucggccugaacaccaagaacgguucaaucagucuuacaugccuggcgcucgggggagugaugauuuucuugucuacugccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10452 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgauugguaaagccuuugaggcaaccgugagaggcgcuaagaggauggccguacuaggggauacugcgugggacuucggauccgugggcggugcccucaauucucuggggaaaggcauccaccagaucuucggagcugcauuuaagucgcuuuucggcgggaugagcugguuuucccaaauuuugaucggaacacugcucauguggcugggccuuaacaccaaaaaugguucaauuagucugaugugcuuggcccucgggggaguucugauauucuuaucuacagcugucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10453 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgcuaggaaaggccuucuccaccacucucaaaggugcucaacgccuggccgcacuuggcgauacagcuugggacuuugggucuaucggaggcguguucaauucgauugguagagccguacaccagguguuugggggcgcguucaggaccuuguuuggaggcaugagcuggaucacacaggggcugaugggagcccuccugcuuuggaugggcguuaacgcucgugaucgguccauugcacuggccuucuuggcuacuggugggguccucguguuucuggccaccaaugugcaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10454 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcacccuaggaaaggccuucuccacuacacucaaaggugcucaacgccuggccgcacuuggcgauaccgcuugggacuuugggucuaucggaggcguauucaauucgaucgguagagccgugcaccagguuuuugggggcgcguucaggacauuguuuggaggcaugagcuggauuacucaggggcugaugggagcccuccugcuuuggaugggcgucaacgcucgugaucgguccaucgcacuggccuucuuggcuaccgguggggugcucguguuucuggccacgaauguccaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10455 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgcuaggaaaggcuuuuuccaccacucucaaaggugcccaacggcuggcagcccuuggcgacacagcuugggauuucgggucuauuggaggcguguuuaauucgaucggucgcgccgugcaccaggucuucgggggcgcauuuagaaccuuguucggaggcaugagcuggaucacacaggggcugaugggagcucuccugcuuuggaugggcguuaacgccagggaccguuccauugcgcuggccuuuuuggcuacugguggggugcucguguuccuggcaaccaacguacaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10456 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgcuaggaaaggccuucuccaccacucucaaaggugcucaacgccuggccgcacuuggcgauacagcuugggacuuugggucuaucggaggcguauucaauucgaucgguagagccgugcaccagguuuuugggggcgcguucaggaccuuguuuggaggcaugagcuggauuacacaggggcugaugggagcccuccugcuuuggaugggcgucaacgcucgugaucgguccaucgcacuggccuucuuggcuacugguggggugcucguguuucuggccaccaauguccaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10457 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacucuaggcaaggcauucaguacaacccucaaaggggcccagagacuggcugcccuuggagacacagcaugggauuucgguagcauuggcggggucuuuaauuccaucggaagggcugugcaucaaguauucggcggugccuuucguacuuuguucgggggcaugucuuggaucacccagggacugaugggcgcgcuccugcuuuggaugggggugaacgcccgggaccgaucgauugcucuggcauuuuuggccacgggaggcguucucgucuuccuggcuaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10458 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacacuaggcaaggcauucaguaccacacucaaaggggcccagagacuggcugcccuuggagacacugcaugggauuucgguagcauaggcgggguguuuaauuccauuggaagggcuguacaucaaguguucggcggugccuuucguaccuuguucgggggcaugucuuggaucacgcagggacugaugggcgcgcuccugcuuuggauggggguuaacgcccgggaccgaucgaucgcucuggcauuuuuggccaccggaggcguccucguguuccuggcuacaaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10459 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacucuaggcaaggcguucaguacaacccucaaaggggcucagcgccuggccgcacuuggagauacagccugggacuuugguagcaucggcggggucuucaauuccauaggcagagcugugcaucaaguguuuggaggugccuucaggacuuuguuugggggcaugucuuggauuacccagggacugaugggcgcacuccugcuuuggaugggggucaacgcucgugaucggucgaucgcccuggcguucuuggccacgggaggcguucucguguuucuggcuaccaacgugcacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10460 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacucuaggcaaggcauucaguacaacccucaaaggggcccagagacuggcugcccuuggagacacagcaugggauuucgguagcauaggcgggguguuuaauuccauuggaagggcuguacaucaaguguucggcggugccuuucguacuuuguucgggggcaugucuuggaucacccagggacugaugggcgcgcuccugcuuuggauggggguuaacgcccgggaccgaucgaucgcucuggcauuuuuggccacgggaggcguccucguguuccuggcuaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10461 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgcuagguaaagccuuuuccaccacucucaagggcgcacagagacuggcugcccuuggggauacagcgugggacuucggaucuaucggcggugucuucaauucgaucgggagggccgugcaccaaguauuuggcggagcuuuccguaccuuguuuggcgggaugagcuggauuacacagggacugaugggcgcacuccugcuuuggaugggugugaacgcccgggaucgauccaucgcucuggccuucuuggcaacugggggaguucucgucuuucuggcgaccaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10462 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcacccuagguaaagccuuuuccacuacacucaagggcgcacagagacuggcugcccuuggggauaccgcgugggacuucggaucuauuggcgguguguucaauucgaucgggagggccguacaccaaguguuuggcggagcuuuccguacauuguuuggcgggaugagcuggaucacucagggacugaugggcgcacuccugcuuuggauggguguuaacgcccgggaucgauccauugcucuggccuucuuggcaaccgggggaguccucguguuucuggcgacgaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10463 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcuugggggauucggcucccugggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgcuagguaaagcauucuccaccacucucaagggcgcccagcgccuggcugcccuuggggacacagcaugggauuucggaucuauaggcggugucuuuaauucgauugggagagcugugcaccaaguguucggcggagccuuuaggaccuuguucggcgggaugagcuggaucacacagggacugaugggcgcgcuccugcuuuggaugggugucaacgcccgugaccgguccaucgcucuggcauuuuuggccacugggggaguucucguguuccuggcuaccaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10464 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgcuagguaaagccuuuuccaccacucucaagggcgcacagagacuggcugcccuuggggauacagcgugggacuucggaucuauuggcgguguguucaauucgaucgggagggccguacaccaaguguuuggcggagcuuuccguaccuuguuuggcgggaugagcuggaucacacagggacugaugggcgcacuccugcuuuggauggguguuaacgcccgggaucgauccauugcucuggccuucuuggcaacugggggaguccucguguuucuggcgaccaaugugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10465 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugaccagcgugggcauugucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugauaucgugcucgagcacggugggugugucacugugauggcccaggacaaaccgacaguagauauugaacugguuaccacgacugugaguaauauggcugaggucagguccuauugcuacgaggccucuaucagcgacauggcguccgauucacggugucccacccagggagaagcauaucuggacaagcaaagugauacacaguacgugugcaaacgcacucucguggacagaggcuggggcaacggguguggauuauuugguaagggcagccuggucacaugcgccaaguucgcuuguucuaaaaagaugacagggaaauccauucagccugagaaucuugaauauaggaucauguugucaguucauggaagccagcacaguggcaugauagugaacgauaccggucaugagacggacgagaaucgggccaagguagaaauuacuccaaacucuccccgcgcagaggcuacacuagggggauuuggcucccugggccucgauugcgaaccucgaaccgggcuggacuucagcgaucuuuacuaccugacuaugaauaacaaacacugguuggugcacaaggagugguuucaugacaucccacuccccuggcacgccggagcggacacagguaccccucauuggaauaacaaggaagcccuggucgaguucaaagaugcacacgcuaagagacaaacggugguuguguuaggcucgcaggagggggccguccacaccgcucuggccggagcacucgaagccgagauggacggcgcuaaagguaggcuuucuuccgggcaucugaagugucgguugaaaauggauaagcuacgucugaaaggcgugucauauagucucugcacagcggcauuuacuuucaccaagauuccagccgaaacacugcacggaacuguaaccguugaggugcaguacgcuggcacagacgggccguguaagguccccgcccagauggcaguggauaugcaaacccuuacuccugucggacgccugaucacggccaauccagugaucacagaaagcaccgagaacuccaaaaugauguuggagcucgaucccccuuuuggugacucuuauauuguuauaggcgugggggaaaagaaaaucacucaucacuggcauagaagcggaucaaccauuggcaaggcuuucgaggccacaguaaggggugcaaaacggauggcgguccugggggacaccgcuugggauuuuggcagugugggaggcgccuuaaauucccuggggaagggaauccaccagauauucggugcagccuucaagagccuauuuggcgggaugucuugguucucacagauucucaucggaacucugcuuaugugguugggccugaacaccaaaaacgguaguaucagccucaugugccuggcucuugggggcguucugaucuuuuuguccacggccgugucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10466 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacgcuaaaaacgguaguaucagccucaugugccuggcccuugggggcgugcugaucuuuuuguccacagcagucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10467 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccagcaucggcauuauagggcugcuccuuacaacugccauggcugcagugacgcugcccucccacucuaccagaaaguugcagacaaggucacaaacuugguuagagagucgggaauacaccaaacaucugaucaaggucgagaacuggauuuuccgcaauccuggauuugcccuaguugcgguggcuaucgccuggcuccuggguagcuccacaucucagaaaguaauuuaucuugugaugauccuguugauagcaccagccuacucgauccgaugcauuggcgucucaaaccgugacuucguggaagggaugagcggaggcaccuggguugaugugguccucgagcacggugggugugugacuguaauggcucaggacaagccgacaguugauaucgaacuggugaccacgacugucaguaauauggcagaggugagauccuauugcuacgaggccucuauuagcgacauggcuuccgauucaaggugucccacccagggagaagccuaucuggacaaacaaagugauacacaguacgugugcaagcggacucucgucgaccgcggcuggggcaacggguguggauuauuugguaagggcagccugguuaccugcgcgaaauucacauguucuaagaaaaugaccgggaaguccauccagccugagaaucuugaauauagaauaauguugucagugcauggaagccagcacaguggcaugauugguuacgagacggaugaggacagggcaaaaguagaagugacuccaaacucuccccgggccgaggcuacacuugggggauuuggcucccuaggccucgauugcgaaccucgcaccgggcuggacuucagcgaucuuuacuaucugacuaugaauaacaagcauugguugguccacaaggagugguuucacgacaucccacuccccuggcaugccggagcagacacagguaccccucacuggaauaacaaagaagcucugguggaguucaaggaugcccaugcgaaacgacaaacgguuguggucuuaggcucgcaggagggggccgugcacaccgcacuggcuggagcccucgaagcugagauggacggcgccaaggguagacuguuuucugggcaccugaaauguagguugaagauggauaaacuacggcugaagggcguauccuacucacucugcacagcagccuucacuuuuaccaagguuccagcugaaacacugcauggaacugugaccgucgaggugcaguaugcgggcacagacgggccguguaaaauucccguccagauggcaguggauaugcaaacccuuacuccuguuggacgucugaucacggccaauccagugaucacagaaaguaccgagaacagcaagaugauguuggagcucgaucccccuuucggugacuccuacauuguaauaggcgucggggacaaaaagaucacucaccauuggcaccgcucuggaagcaccauuggcaaggcuuuugaagccacagugagaggugcaaaaaggauggccguucugggggauaccgcuugggacuucggcucagugggaggcgucuucaauaguuuagggaagggaauccaucagauauuuggugccgcauucaaaucccuguuuggcgggaugagcugguucucucagauucuaaucggaacucuccugguguggcuuggcuugaacacaaagaaugguucaaucagucugacgugccucgcgcuugggggcguaaugauuuuucugagcaccgcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10468 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacacgaaaaacgguaguaucagccucaugugccuggcucuugggggcgugcugaucuuuuuguccacagccgucucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10469 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggauaucgucuuggaacacggugggugugugaccguaauggcccaggacaaacccacaguugauauugagcucgugaccacuacagucucuaauauggcggaggugaggagcuauugcuacgaagcauccaucucagacauggccagugauagccgguguccuacccaaggagaggcuuaucuggacaagcagucugauacgcaguacgugugcaaacgcacucuggucgacagaggcuggggcaacggguguggacucuuugguaagggcuccuuaguuaccugcgccaaguucgcauguagcaaaaagaugacagggaaaucaauacagccagaaaaucuggaguauaggauuaugcuuagugugcauggaucucaacacuccggcaugaucguaaacgauacuggucaugagaccgacgaaaaucgggcuaagguggagauuacacccaacagcccucgcgccgaagcgaccuugggaggauuuggcucgcugggccuagauugcgagccacgaacggggcucgacuucucugaucuguacuaccuuacuaugaauaacaaacacuggcugguccacaaggaaugguuucaugacauccccuugccuuggcacgccggagcagacacagguaccccacauuggaauaacaaggaggcucucguggaguucaaagaugcccacgcuaagagacagacuguugugguccugggcucccaggaaggggccgugcacacagcauuagccggagcucuggaggcggaaauggacggcgcaaaagguaggcucucaagugggcaucuuaagugucggcugaaaauggauaaguugcgucuaaaaggcguaagcuauucccugugcaccgccgcuuuuacguucaccaagaucccggccgagacacuccacggaacuguuaccguggaaguccaguacgcaggcacagacgggcccuguaaggugccugcccaaauggcugucgauaugcagacucugaccccagugggacgccuuauuacagccaaucccguuauaaccgagucuacugagaacagcaaaaugaugcuggaauuggacccuccauuuggugauucauauaucgugauuggcguaggggagaagaaaaucacgcaucacuggcauagaaguggauccacaauaggcaaggcauucgaagcgaccgucaggggugcuaaacggauggccgugcucggggacacugcaugggauuucggcagcguuggaggcgccuuaaauucucuggggaaggggauucaccagaucuuuggugcugccuucaagucacuguuuggcgggaugaguugguucagccaaauccuaauuggaacccuccugauguggcuuggcuugaacaccaaaaacgguuccaucucucugaugugccucgcacuugggggcgugcugauuuuucugucgacagcugucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10470 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacgcuaaaaacgguuccauuucucugaugugccucgcacuugggggcguccugaucuuucugucgacagccgugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10471 - RNA, 2185 nt, Artificial Sequence
  ZIKV (strain MR 766) ME variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaaucaagguagaaaacuggauuuuccgcaauccaggauuugcucugguggccgucgcaaucgccuggcuacucgguucuucgacaucacagaaagugauuuaucugguuaugauccuucugauagcuccggcauacagcauccgaugcauuggcgugaguaaccgugacuucgucgaggggauguccggaggcacuuggguggauguaguuuuggaacacggugggugugugaccgucauggcccaggacaagcccacaguggauaucgagcucgugaccacuacagucucuaauauggcugagguuagaagcuauugcuacgaagccuccauuucagacauggcgagugauucuagguguccuacccaaggagaggcauaucuggacaaacagagcgauacgcaguacgugugcaagcggacucugguagaccgcggcuggggcaacggguguggacucuuugguaagggcuccuuagugaccugcgccaaauucacauguucaaagaaaaugacuggaaagagcauccagccagaaaaucuggaguauagaauaaugcuuaguguccaugggucucaacacuccggcaugauugguuacgagaccgaugaagacagggcuaaaguggagguuacacccaacagcccucgggccgaagcaaccuugggaggguuuggcucgcugggccuagauugcgagccacgcacggggcucgacuucucugaucuguacuaucuuacuaugaauaacaagcauuggcuggugcacaaggaaugguuucacgacauccccuugccuuggcaugcuggagccgacacagguaccccacacuggaauaacaaagaggcgcucgucgaguucaaggaugcccaugcaaaacgacagacugugguaguucugggcucccaggaaggggcugugcacacagccuuagcuggagcccuggaggcagaaauggacggcgccaaggguagacucuuuucagggcaccuuaaauguaggcugaagauggauaaauugcggcuaaagggcgucaguuacagccugugcaccgcugcguucacguuuaccaaggugccggcagagacacuccauggaacugucaccguggaaguucaguaugccggcacagacgggcccuguaaaauuccugugcaaauggcuguagauaugcagacucugaccccagucggacgucuuaucacagccaaucccgugaucaccgaguccacugagaacucuaagaugaugcuggaauuggacccuccauucggugauagcuacauuguuauaggcgugggggacaaaaagaucacgcaccauuggcaccgcucaggaaguacaauuggcaaagcauucgaggccaccgucagaggugcuaagaggauggccgugcucggggauacugcaugggacuuuggcuccguaggaggcguguucaauagccuggggaagggaauccaucagauauuuggugcggcuuucaaaucuuuauuuggcgggaugucaugguucagucaaauucugaucggaacccuacucguuuggcugggccuuaacacaaagaaugguagcaucuccuugaccugccuggcccucgggggcgucaugauuuuucugucuacugcagugucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10472 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacaccaaaaacgguuccauuucucugaugugccucgcacuugggggcguccugaucuuucugucgacagcugugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10473 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacaucguguuggagcauggaggcugugucaccgugauggcucaggauaaaccgacuguagacauugaacucguuacaaccacggugaguaauauggccgagguccgguccuauugcuacgaggcgucuaucagcgauauggcauccgacucacgcugucccacucagggugaagccuaucuggauaagcaaagugacacccaguacgugugcaaaagaacacugguggauaggggguggggaaacggcuguggccucuucgggaaggggagcuuagucacuugcgcuaaguuugccuguucuaaaaagaugaccgguaaauccauucagccugagaaucuggaauaucggaucaugcuuucaguucacggcagccagcauagugggaugauagugaacgacacaggacacgagaccgaugagaaucgcgcaaagguagaaauuacgccaaacucuccccgagcugaggccacuuugggcgguuucgggucccugggacuagacugcgaaccuagaacaggccucgauuuuagcgaccuguacuaccuuaccaugaauaacaaacacuggcuggugcauaaggagugguuccacgacaucccauugcccuggcaugcgggcgccgauacugggacaccucacuggaauaacaaggaagcacucgucgaguuuaaagacgcucacgccaagaggcaaaccgugguugugcugggaucgcaggagggugcuguccauacggccuuagcaggcgcccuggaagcugagauggauggggcgaaaggacggcucucuuccggccaccuuaagugucgucugaaaauggacaaguugcgccuaaaaggugugucauauagucugugcaccgcagccuucacauuuacuaagauuccagcugaaacccuccaugggacaguaacuguugaggugcaguacgccggcaccgauggaccguguaagguccccgcacagauggccguggacaugcaaacacugaccccugucggcagacuuaucacugcuaauccagugaucacggaaagcacagagaacuccaaaaugaugcuggaguuggaucccccuuucggggacucuuauauuguuauaggagugggugaaaagaaaaucacccaccauuggcacaggagcggcucaacuauugggaaggccuuugaggcaaccguacggggagcgaaacgaauggcuguccucggcgauacagccugggacuucgguagugugggaggcgcauuaaauucccugggaaagggcauccaccagauauucggggccgcuuuuaagagccuguucggagguaugucuugguuuucacagauucuaaucggcacccuccugauguggcuuggguugaacacuaaaaacggaaguaucagccugaugugccucgcccugggcgguguucuuauuuuccuguccacagcagugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10474 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacgccaaaaacggaaguaucagccugaugugccucgcacugggcggugugcuuaucuuccuguccacugcugucucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10475 - RNA, 2164 nt, Artificial Sequence
  ZIKV (strain MR 766) ME variant mRNA Design 2 opt
ggggcgcugccuacggagguggcagccaucuccuucucggcaucaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauuaagguggagaacuggauauuucgaaauccuggcuucgcgcugguagcuguggccaucgcauggcuacucgggagcuccaccucucagaaagucauuuaucuggugaugauccuucugauugccccagcuuacucgauccguugcauaggaguuucaaacagagauuuuguggaagguaugagcggcgggacaugggucgacgugguauuggagcauggaggcuguguuaccgugauggcacaggauaagccgacugucgacaucgaacucgugacaaccacggugaguaauauggccgaggucagguccuauugcuacgaggcuucuauuagcgauauggccuccgacucacggugucccacucagggugaagcguaucuggauaaacaaagugacacccaguacguuugcaagcgcacacugguggauagaggguggggaaacggcuguggccucuucgggaaggggagcuuaguaacuugcgcaaaauuuaccuguucuaagaaaaugacagguaaguccauccagccugagaaucuggaauauaggauuaugcuuucagugcacggcagccagcauagugggaugaucggauacgagaccgacgaggaucgggccaaagucgaagugacgccaaacucuccccgcgcugaggccacuuugggcgguuucgggucccugggacuagacugcgaaccucgaacaggccucgauuuuagcgaccuguacuaucuuaccaugaauaacaagcacuggcugguucacaaggagugguuccaugacauaccauugcccuggcacgcaggcgcugauacugggacaccucauuggaauaacaaagaagcccucguggaguuuaaggacgcgcacgccaaaagacaaaccgucgugguacugggaucgcaggagggugcaguucacacggcuuuagccggcgcucuggaagccgagauggauggggcaaagggaaggcuuuucucuggccaucucaaaugucggcugaagauggacaaauugcgucuaaaggguguguccuacucacugugcaccgccgcuuuuacauucacuaaggucccagcggaaacccuccacgggacagugacugucgaggugcaguaugcaggcaccgauggaccguguaaaauucccguucagauggccguggacaugcaaacacugaccccuguaggccgccuuaucacugcuaauccagucauuacggaaaguacagagaacagcaagaugaugcuggaguuggaucccccuuuuggggacuccuacaucgugaucggaguuggugauaaaaagauuacccaucacuggcauagaucuggcagcacuauagggaaagccuucgaagcaaccgugaggggagccaagcggauggcuguccucggcgacacagccugggauuucgguucagugggaggcguauuuaauagucugggaaagggcauccaccagauuuucggggcagcguuuaaauccuuauucggagguaugagcugguuuucucagauccugauaggcacccuacucguguggcuggggcuuaacacuaagaauggaucaauuaguuugacaugccuggcucucggcgguguuaugaucuuccugagcacggccgucuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10476 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacacuaaaaacggaaguaucagccugaugugccucgcccugggcggugugcuuaucuuccuguccacagcagucucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10477 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauauuguguuggagcacgggggaugcgucaccgugauggcacaggacaagccgacaguagauaucgaacucguuaccacuacagugucuaauauggccgagguccggagcuauuguuacgaggcuuccauuucagacauggccagugauagccgcugccccacccagggcgaagcauaucuggacaaacaaucugauacgcaguacguguguaagagaacucugguggacaggggcugggggaacggaugcggucucuuuggcaagggguccuuagucaccugugcuaaauucgccugcucaaagaaaaugacaggaaagagcauccagccugagaaucuggaauaucggauaaugcuuaguguucauggcucucagcacuccgguaugauugugaacgauacugggcaugagaccgacgagaaucgcgcgaaaguagaaaucacaccaaacagcccccgagccgaggcaaccuugggaggcuuuggcucgcuggggcuagauugugaaccuagaacgggacucgacuucucugaucuguacuaccuuacuaugaauaacaagcacuggcuggugcacaaggagugguuucaugacauuccauugcccuggcacgcuggugccgacacaggcaccccucauuggaauaacaaagaagcucucgucgaguucaaggaugcccacgcaaaaaggcaaacugugguugugcuggggucccaggagggagccguccacacagcuuuagcgggcgcacuggaagccgagauggacggugcuaaggggcggcucucaaguggccaucuuaaaugccgucugaagauggauaaauugcgccuaaagggagugagcuauucccuguguaccgccgcauuuacguucaccaagaucccagccgaaacacuccacggcacuguaaccguugaggugcaguacgcugggacagacggaccgugcaaaguccccgcccagauggcaguggauaugcaaacucugaccccugucgguagacuuaucacagcgaauccagugauuaccgaaucuacugagaacagcaagaugaugcuggaguuggaucccccuuuuggcgacucauauauaguuaucggggugggagagaaaaagauuacgcaucacuggcauaggaguggcuccacaaucgguaaggcuuucgaagccaccguacggggcgcaaaacgaauggccguccucggcgacacugcuugggauuuuggaagcgugggcggggccuuaaauucucugggaaaggguauacaccagauuuucggcgcagcuuucaaaucacuguuugggggaaugaguugguucagccagauccuaaucggcacccuccugauguggcuugguuugaacacaaagaacggguccauuucucugaugugccucgcccugggcggaguucuuaucuuucugucgaccgcggugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10478 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacgccaagaacggguccaucucucugaugugccucgcgcugggcggagugcuuauuuuucugucgacagccgucagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10479 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauaaaaguggagaacuggaucuuccgaaauccugguuuugcacugguagccguggcuauugcauggcuacucgggucuucgacaucacagaaggucaucuaucuggugaugauucuucugaucgccccagcuuacagcauacguuguaucgggguuaguaacagagacuucguggaaggaauguccggcgguacuugggucgaugugguauuggagcacgggggaugcguuaccgugauggcccaggacaaaccgacagucgauauugaacucgugaccacuacagugucuaauauggcggaggucaggagcuauuguuacgaggcauccaucucagacauggccagugauagccggugccccacccagggcgaggcuuaucuggacaagcaaucugauacgcaguacguuuguaagcgcacucugguggacagaggcugggggaacggaugcggucucuuuggcaaaggguccuuaguaaccugugccaaguucacaugcagcaaaaagaugacuggaaaaucaauucagccugaaaaucuggaauauaggaucaugcuuagugugcauggcucucagcacuccgguaugauaggguacgagaccgaugaggaccgggcaaaggucgaagugacaccaaacagcccccgcgcugaggccaccuugggaggcuuuggcucgcuggggcuagauugugaaccucgaacgggacucgacuucucugaucuguacuaucuuacuaugaauaacaagcauuggcugguucacaaagagugguuucacgacauuccauugcccuggcaugcgggugccgacacaggcaccccucacuggaauaacaaggaagcacucguggaguucaaagaugcucaugccaagagacaaacugucgugguacuggggucccaggagggagcuguucacacagccuuagcaggcgcccuggaagcugagauggacggugcgaaagggaggcucuuuucaggccaccuuaagugccggcugaaaauggauaaguugcgucuaaagggagugaguuacagccuguguaccgcagccuucacguuuaccaaagucccagcugaaacacuccauggcacugugaccgucgaggugcaguaugccgggacagacggaccgugcaagauccccguucagauggcaguggauaugcaaacucugaccccuguaggucgccuuauuacagccaauccagucaucaccgaauccacugagaacucuaaaaugaugcuggaguuggaucccccuuucggcgacagcuacaucgugauugggguuggagacaagaaaauaacgcaccauuggcacagaucaggcaguacaaucgguaaggcuuuugaagccaccgugaggggcgcaaagcggauggcgguccucggcgauacugcuugggacuucggauccgugggcgggguauucaauagccugggaaaagguauucaucagaucuuuggcgccgcauucaagucuuuauuugggggaaugucaugguucagucagauacugauuggcacccuacucguguggcugggucuuaacaccaaaaaugggagcaucuccuugacaugccuggcccucggcggaguuaugaucuuucugucuacugcugucucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10480 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacacaaagaacggguccaucucucugaugugccucgcccugggcggagugcuuauuuuucugucgaccgcggucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10481 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10482 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10483 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10484 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10485 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10486 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10487 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10488 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10489 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10490 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10491 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10492 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10493 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10494 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10495 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10496 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10497 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10498 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10499 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10500 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10501 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10502 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10503 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10504 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10505 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10506 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10507 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccagcaucggcaucaucggccugcugcugaccaccgccauggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10508 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10509 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10510 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10511 - RNA, 2185 nt, Artificial Sequence
  ZIKV (strain MR 766) ME variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10512 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10513 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10514 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10515 - RNA, 2164 nt, Artificial Sequence
  ZIKV (strain MR 766) ME variant mRNA Design 2 opt
ggggcgcugccuacggagguggcagccaucuccuucucggcaucaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10516 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10517 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10518 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10519 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10520 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10521 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcugugggcuguucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgauuggcaaggcguucgaagccacagugcggggcgcuaaaagaauggccguccuuggagauaccgcuugggacuuuggcagcguugggggagcccucaauucccucggcaaggggauccaccaaaucuucggcgccgcuuuuaaaucucuguucggaggcaugagcugguuuucccagauucugaucgggacacuucucauguggcugggacugaacaccaagaauggcagcauuucucucaugugucuggcgcuugggggagugcugaucuuccucuccaccgccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10522 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcugugggcuguucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacaaucggcaaggcguucgaagccaccguccggggcgcuaaaagaauggccgugcuuggagauacagcuugggacuuuggcagcguugggggagcccucaauucccucggcaaggggauucaccaaaucuucggcgccgcuuuuaaaucucuguucggaggcaugagcugguuuucccagauccugauugggacccuucucauguggcugggacugaacgcgaagaauggcagcaucucucucaugugucuggcccuugggggagugcugauuuuccucuccaccgcugucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10523 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcugcagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcuguggacucuucgggaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgauuggcaaggccuuugaggcuacaguccgcggggccaaacggauggcggugcuuggagacaccgccugggauuucggcagcguugggggaguguuuaauucccugggcaaggggauccaccaaauuuucggcgcugccuuuaaaucucucuucggaggcaugagcugguuuucccagauccugaucgggacacugcuugucuggcucggacugaacaccaagaacggcagcauuucucugaccugucucgcucuugggggagugaugaucuuccuuuccacagccguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10524 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcugugggcuguucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgaucggcaaggcguucgaagccacaguccggggcgcuaaaagaauggccgugcuuggagauaccgcuugggacuuuggcagcguugggggagcccucaauucccucggcaaggggauucaccaaaucuucggcgccgcuuuuaaaucucuguucggaggcaugagcugguuuucccagauccugauugggacacuucucauguggcugggacugaacaccaagaauggcagcaucucucucaugugucuggcgcuugggggagugcugauuuuccucuccaccgccgucagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10525 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcaccauuggcaaggccuucgaggcgacagugagaggagccaaacgcauggcugugcuuggcgacaccgccugggauuucggguccgucggaggcgcucucaauucucuggggaagggaauccaucagauuuuuggcgccgccuucaaaagccuguuugggggcauguccugguucucucaaauccugaucggaacccuucucauguggcugggccugaacacaaagaaugggagcauuucccucaugugucuggcucuuggaggcgugcugaucuuucucagcacggcgguuucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10526 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacaaucggcaaggccuucgaggcgaccgugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacacuucucauguggcugggccugaacgcuaagaaugggagcaucucccucaugugucuggcgcuuggaggcguucugauuuuucucagcacggccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10527 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcaccauuggcaaggcuuucgaagccacagugcggggagcuaaaagaauggccguccuuggcgauaccgcgugggacuuuggguccgugggaggcguuuucaauucucuggggaagggaauccaucagauuuuuggcgccgcuuucaaaagccucuuugggggcauguccugguucucucaaauccugauuggaacccugcuuguguggcucggccugaacacaaagaacgggagcaucucccugacgugucucgcccugggaggcgucaugaucuuucuuagcaccgcugugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10528 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcaccaucggcaaggccuucgaggcgacagugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacccuucucauguggcugggccugaacacaaagaaugggagcaucucccucaugugucuggcucuuggaggcguucugauuuuucucagcacggcggugucugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10529 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgaucgggaaggcuuuugaggccacagugagaggagcuaagcgcauggccgugcuuggcgauaccgccugggacuucgggagcgucggaggcgcucucaauucccuggggaaaggcauucaccagaucuucggagcggccuuuaagucucuguucggcgggaugagcugguuuucccaaauccugauuggaacacuucucauguggcugggccugaacaccaaaaaugggagcaucucucucaugugccuggcucuuggaggcgugcugauuuuccucuccaccgccguuagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10530 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacaauugggaaggcuuuugaggccaccgugagaggagcuaagcgcauggccguccuuggcgauacagccugggacuucgggagcgugggaggcgcucucaauucccuggggaaaggcauccaccagauuuucggagcggccuuuaagucucuguucggcgggaugagcugguuuucccaaauccugaucggaacccuucucauguggcugggccugaacgcuaaaaaugggagcauuucucucaugugccuggcccuuggaggcguucugaucuuccucuccaccgccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10531 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgaucgggaaagccuucgaagcgacagugcggggagccaagagaauggcuguccuuggcgacaccgccugggauuucgggagcgugggaggcguuuuuaauucccuggggaaaggcauucaccagaucuucggagcugccuuuaagucucucuucggcgggaugagcugguuuucccaaauucugaucggaacacugcuuguguggcucggccugaacaccaagaacgggagcaucucucugaccugccucgcccugggaggcgucaugauuuuccuuuccacagcugugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10532 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgauugggaaggcuuuugaggccacagugagaggagcuaagcgcauggccguccuuggcgauaccgccugggacuucgggagcgugggaggcgcucucaauucccuggggaaaggcauccaccagauuuucggagcggccuuuaagucucuguucggcgggaugagcugguuuucccaaauccugaucggaacacuucucauguggcugggccugaacaccaaaaaugggagcauuucucucaugugccuggcucuuggaggcguucugaucuuccucuccaccgccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10533 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcuguggccucuucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgcuuggcaaggcguucagcacaacccugaaaggggcccaacggcucgcugcccugggagauacagcuugggacuuuggcuccauugggggaguguucaauucuaucggcagagccguccaccagguguuugggggcgccuuccgcacccuguuuggaggcaugagcuggaucacccaggggcuuaugggagcucuccugcuguggaugggcguuaacgcgcgggauagauccauugcccucgcuuuccuggccacagggggagugcuugucuuucuggccacgaaugugcaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10534 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcuguggccucuucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacacuuggcaaggcguucagcaccacacugaaaggggcccaacggcucgcugcccugggagauaccgcuugggacuuuggcuccaucgggggagucuucaauucuauuggcagagccgugcaccagguuuuugggggcgccuuccgcacccuguuuggaggcaugagcuggaucacacaggggcuuaugggagcucuccugcuguggaugggcgugaacgcgcgggauagauccaucgcccucgcuuuccuggccaccgggggaguccuuguguuucuggccacgaauguucaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10535 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcuccagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcugugggcuuuucggaaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgcuuggcaaggccuuuagcacaacccugaaaggggcucaacgccucgccgcgcugggagacacagccugggauuucggcuccauugggggagucuuuaauucuaucggccgggcugugcaccagguuuucgggggcgccuuuagaacccuguucggaggcaugagcuggauuacccaggggcuuaugggagcucuccugcuguggaugggcgugaacgcccgcgaccgguccaucgcccucgcuuuucuggcgacagggggaguccuuguguuccuggccacgaacguucaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10536 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcuguggccucuucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgcuuggcaaggcguucagcacaacccugaaaggggcccaacggcucgcugcccugggagauacagcuugggacuuuggcuccaucgggggagucuucaauucuauuggcagagccgugcaccagguuuuugggggcgccuuccgcacccuguuuggaggcaugagcuggaucacccaggggcuuaugggagcucuccugcuguggaugggcgugaacgcgcgggauagauccaucgcccucgcuuuccuggccacagggggaguccuuguguuucuggccacgaauguucaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10537 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcacccuuggcaaggccuucuccacaacccugaaaggagcgcagagacucgccgcucugggcgacaccgccugggauuucgggucuauuggaggcguguuuaauagcaucgggcgcgcugugcaucaagucuucggaggcgccuuucggacacuguucgggggcauguccuggauuacgcagggacuuaugggcgcccuccugcuguggaugggggugaacgcuagagaccgcucuaucgcgcucgccuuucuggcuaccggaggcguucuuguguuccuggccacaaauguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10538 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacacuuggcaaggccuucuccaccacccugaaaggagcgcagagacucgccgcucugggcgacacagccugggauuucgggucuaucggaggcguguuuaauagcauugggcgcgcuguccaucaaguguucggaggcgccuuucggacgcuguucgggggcauguccuggaucacccagggacuuaugggcgcccuccugcuguggauggggguuaacgcuagagaccgcucuauugcgcucgccuuucuggcuacaggaggcgugcuugucuuccuggccaccaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10539 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcacccuuggcaaggcuuucuccacaacccugaaaggagcccagcggcucgcugcccugggcgauaccgcgugggacuuugggucuauuggaggcguguucaauagcaucgggagagccguccaucaaguguuuggaggcgcuuuccgcacacuguuugggggcauguccuggauuacgcagggacuuaugggcgcccuccugcuguggauggggguuaacgcucgggauagaucuaucgcccucgccuuccuggcuaccggaggcgugcuugucuuucuggcgacaaacgugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10540 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcacccuuggcaaggccuucuccacaacccugaaaggagcgcagagacucgccgcucugggcgacaccgccugggauuucgggucuaucggaggcguguuuaauagcauugggcgcgcuguccaucaaguguucggaggcgccuuucggacacuguucgggggcauguccuggaucacgcagggacuuaugggcgcccuccugcuguggauggggguuaacgcuagagaccgcucuauugcgcucgccuuucuggcuaccggaggcgugcuugucuuccuggccacaaaugugcacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10541 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgcuugggaaggcuuuuagcacaacccugaagggagcccagagacucgcugcccugggcgauacagccugggacuucggguccaucggaggcguguucaauucuauugggcgcgcugugcaccaagucuuuggcggagcguuccggacccuguuuggcgggaugagcuggaucacccagggacuuaugggcgcccuccugcuguggaugggggugaacgcuagagaucgcuccaucgcccucgccuuccuggcuacaggaggcguucuuguguuucuggccacgaauguccaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10542 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacacuugggaaggcuuuuagcaccacacugaagggagcccagagacucgcugcccugggcgauaccgccugggacuucggguccauuggaggcguguucaauucuaucgggcgcgcuguccaccaaguguuuggcggagcguuccggacccuguuuggcgggaugagcuggauuacacagggacuuaugggcgcccuccugcuguggauggggguuaacgcuagagaucgcuccaucgcccucgccuuccuggcuacgggaggcgugcuugucuuucuggccaccaaugugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10543 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgcuugggaaagccuucagcacaacccugaagggagcgcagcggcucgccgcucugggcgacacagccugggauuucggguccaucggaggcguguuuaauucuauugggagagcuguccaccaaguguucggcggagccuuucgcacccuguucggcgggaugagcuggaucacccagggacuuaugggcgcccuccugcuguggauggggguuaacgcucgggacagauccauugcgcucgccuuucuggcuacaggaggcgugcuugucuuccuggccacgaacgugcaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10544 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgcuugggaaggcuuuuagcacaacccugaagggagcccagagacucgcugcccugggcgauacagccugggacuucggguccauuggaggcguguucaauucuaucgggcgcgcuguccaccaaguguuuggcggagcguuccggacccuguuuggcgggaugagcuggauuacccagggacuuaugggcgcccuccugcuguggauggggguuaacgcuagagaucgcuccaucgcccucgccuuccuggcuacaggaggcgugcuugucuuucuggccacgaaugugcaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10545 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggauaucguccuggagcacggaggcugugugacgguuauggcgcaggacaaacccaccguggauauugaacuugucacaaccacagugagcaauauggccgaggugcggucuuauugcuacgaggcuuccaucagcgacauggccucugauucccgcuguccuacccagggcgaggcuuaucuggacaagcaaagcgauacgcaguacgucugcaaaagaacacucguugaccggggguggggaaacggcugugggcuguuuggaaagggcucucuugugaccugcgccaaguucgcguguuccaaaaagaugacagggaaaagcauucagcccgaaaaucuggaauaucgcaucaugcucuccgugcauggaucucagcacagcggcaugauugucaacgauaccggccaugagaccgacgagaauagagccaagguggaaaucacaccuaacagcccccgggcugaggccacgcuugggggauuuggcucccuggggcucgauugcgaaccucgcaccggacuggacuucucugaucuuuacuaccugacaaugaauaacaaacacuggcucguucacaaggagugguuucaugacaucccgcugcccuggcacgcuggcgccgacaccgggacaccucauuggaauaacaaggaagcccuuguggaguucaaagaugcucacgcgaagagacaaaccgucgugguucugggaucccaggagggcgccgugcacacggcucucgccggcgcccuggaagcugagauggacggggccaaaggacggcugagcucuggccaucucaagugucgccugaaaauggauaagcugagacugaaaggggucagcuauucccucugcacagcggcuuuuaccuucaccaagauucccgccgaaacacugcacggaaccgugacagucgaggugcaguacgccggcacggacgggccuuguaagguucccgcucagauggccguggauaugcaaacccuuacaccggucggccggcugaucaccgcuaauccugugauuacagaaucuaccgagaacagcaaaaugaugcucgagcuggaucccccuuuuggagacuccuauaucguuauuggcgugggggaaaagaaaaucacgcaucacuggcauagaagcggaucuaccaucggcaaggccuucgaggcgacaguccgcggggccaaacggauggcugugcugggagacaccgccugggauuuuggcuccguugggggcgcucucaauagccugggaaagggcauucaccagaucuucggggccgcguucaagucucuuuuuggaggcauguccugguucagccagauucugaucgggacacuccugauguggcugggacuuaacaccaaaaacggcuccauuucucucaugugccuggcccucgggggcgugcugaucuuucugagcacggcugucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10546 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacgccaaaaacggcuccaucucucucaugugccuggcucucgggggcguccugauuuuucugagcaccgccguguccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10547 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccagcaucggcauuaucgggcugcugcugacaacggccauggcugccgugacccuucccucccacucuacaagaaagcugcagacccggagccaaacauggcucgagucccgcgaauacaccaaacaucugauuaaggucgagaacuggaucuucagaaauccuggauuugcgcuuguugcuguggccauugccuggcugcucggcucuagcacaucccagaaagugaucuaucuggucaugauccugcucauugcuccggccuacucuauccggugcauuggggugagcaaccgcgacuucguugaaggaauguccggcgggaccuggguggaugucgugcuggagcacggaggcuguguuacggugauggcucaggacaagcccaccgucgauaucgaacuugugacaaccacagugagcaauauggccgaggucagaucuuauugcuacgaggcguccauuagcgacauggccucugauucccgguguccuacccagggcgaggcuuaucuggacaaacaaagcgauacgcaguacguuugcaagcgcacacucguggacagaggguggggaaacggcugugggcuguuuggaaagggcucucuugugaccugcgccaaauucacauguuccaagaaaaugaccggaaagagcauccagcccgaaaaucuggaauaucggauuaugcucuccguccaugggucucagcacagcggcaugaucggcuacgagaccgaugaggaccgcgcuaaaguggaaguuacaccuaacucccccagagccgaggcgacgcucgggggauuuggcagccuggggcuggauugcgaaccucggaccggacuggacuucucugaucuuuacuaucugacaaugaauaacaagcauuggcucgugcacaaggagugguuucacgacaucccgcugcccuggcaugccggcgcugacaccgggacaccucacuggaauaacaaagaagcccuugucgaguucaaggaugcucaugccaaacgccaaaccgugguugugcugggaucccaggagggcgccguccacacggcucucgcgggcgcccuggaagcugagauggacggggccaagggaagacuguuuagcggccaccucaaaugucggcugaagauggauaaacuucgccugaagggggugucuuacagccucugcacagccgcuuucaccuuuaccaagguccccgccgaaacacugcauggaaccgugacaguugaggugcaguaugcgggcacggacgggccuuguaaaauucccguccagauggcuguggauaugcaaacccuuacaccgguuggcagacugaucaccgccaauccugugauuacagaauccaccgagaacucuaagaugaugcucgagcuggaucccccuuucggagacagcuacaucgucauuggcgugggggacaaaaagaucacgcaccauuggcaccgguccggaagcaccaucggcaaagccuuugaagcuacagugagaggggccaagcgcauggcuguucugggagauaccgccugggacuucggcucugucgggggcguguucaauucccucggaaagggcauucaucagaucuuuggggcggccuucaaaagccuguuuggaggcaugucuugguucucccagauucuuaucgggacacugcucguguggcugggacugaacaccaagaauggcagcauuucccuuacgugccucgcucucgggggcgucaugaucuuucugucuacagccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10548 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacaccaaaaacggcuccaucucucucaugugccuggcccucgggggcguccugauuuuucugagcacggcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10549 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgauaucgugcucgaacacggaggcuguguuaccgugauggcucaggacaaaccuacagucgauauugagcuggugaccacgaccguguccaauauggccgagguccggagcuauugcuacgaggcuucuaucuccgacauggccagcgauucucgcugucccacacaaggcgaagcguaucuugacaagcaguccgauacccaguacguuugcaaaagaacacugguggaccggggguggggaaacggcugugggcucuuuggaaagggcagccuggugaccugcgccaaguucgcuuguuccaaaaagaugacggggaaaucuauucagccugaaaaucuugaguaucgcaucaugcugagcguccauggaucccaacacagcggcaugaucgugaacgauacaggccaugagaccgacgaaaauagagccaagguugagauuacacccaacucuccucgggcugaagccacccucgggggauuuggcucccuggggcuggauugcgagccgcgcaccggacucgacuucagcgaucuguacuaccuuacaaugaauaacaaacacuggcuggugcacaaggaaugguuucaugacaucccccucccuuggcacgccggcgcugacacggggacaccccauuggaauaacaaggaggcgcuggucgaguucaaagaugcccacgcuaagagacagacagugguugugcuuggaucucaggaaggcgccguccacaccgcccuggcuggcgcccucgaggcggaaauggacggggcuaaaggacggcugagcuccggccaucugaagugucgccucaaaauggauaagcugagacuuaaaggggugucuuauagccugugcacagccgccuuuaccuucacgaagauuccugcugagacacuccacggaaccgucaccguggaaguucaguacgccggcacagacgggcccuguaaggugccggcucaaauggccgucgauaugcagacccugacaccugugggccggcuuaucacggcgaaucccguuauuaccgaguccacagagaacagcaaaaugaugcuggaacucgacccucccuuuggagauucuuauaucgugaucggcgucggggagaagaaaauuacccaucacuggcauagauccggaagcacaaucggcaaggccuucgaagcuaccgugcgcggggccaaacggauggcugugcugggagacacggccugggauuucggcucuguugggggcgcgcuuaauucccucggaaagggcauucaccagaucuuuggggccgcuuucaagagccuguuuggaggcauguccugguucucucaaauucuuaucgggacccugcucauguggcugggacugaacaccaaaaacggcagcaucucccuuaugugccucgcccucgggggcguccugauuuuucugucuaccgcugugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10550 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagaccguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacgccaaaaacggcagcaucucccuuaugugccucgcucucgggggcgugcugaucuuucugucuacagccgugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10551 - RNA, 2185 nt, Artificial Sequence
  ZIKV (strain MR 766) ME variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggcugugacccugccuagccacuccacaagaaaacuucaaacgcggucucagaccuggcuggaaagccgcgaguacacaaagcaucucauuaagguggaaaacuggaucuucagaaauccgggauuugcccuggucgccguggcuauugccuggcuucugggcuccucuaccagccagaaaguuaucuaucucgugaugauccugcugauugcucccgccuacuccauccggugcauuggggucagcaaccgcgacuucguggagggaaugucuggcgggacauggguugaugugguccucgaacacggaggcugugugaccgugauggcgcaggacaagccuacagucgauaucgagcugguuaccacgaccguguccaauauggccgaggugagaagcuauugcuacgaagccucuauuuccgacauggcuagcgauucucggugucccacacaaggcgaggcuuaucuugacaaacaguccgauacccaguacgucugcaagcgcacacugguggacagaggguggggaaacggcugugggcucuuuggaaagggcagccugguuaccugcgccaaauucacguguuccaagaaaaugacagggaagucuauccagccugaaaaucuugaguaucggauuaugcugagcgugcauggaucccaacacagcggcaugaucggcuacgagaccgaugaagaccgcgcgaaagucgaggugacacccaacucuccuagagccgaagcuacccucgggggauuuggcucccuggggcuggauugcgagccgcggaccggacucgacuucagcgaucuguacuaucuuacaaugaauaacaagcauuggcugguucacaaggaaugguuucacgacaucccccucccuuggcaugccggcgcugacacggggacaccccacuggaauaacaaagaggcccugguggaguucaaggaugcccaugcuaaacgccagaccgucgugguccuuggaucucaggaaggcgcggugcacaccgcccuggcuggcgcccucgaggccgaaauggacggggcuaagggaagacuguuuagcggccaccugaaaugucggcucaagauggauaaacugcgccuuaaggggguuuccuacucucugugcacagccgcguucaccuuuacgaaggugccugcugagacacuccauggaaccgucaccguggaaguucaguaugccggcacagacgggcccuguaaaauuccggugcaaauggccgucgauaugcagacccugacaccugugggcagacuuaucacggcuaaucccgugauuaccgagagcacagagaacuccaagaugaugcuggaacucgacccucccuucggagauagcuacaucguuauuggcgucggggacaaaaagaucacccaccauuggcaccggucuggauccacaaucggcaaagccuucgaggcuaccgugagaggggccaagcgcauggcggugcugggagauacggccugggacuuuggcagcgucgggggcguguucaauucucugggaaagggcauucaucagaucuuuggggcugccuucaaaucccucuuuggaggcaugagcugguucucccaaauucugaucgggacccuucugguuuggcucggacugaacacaaagaauggcucuauuagccugaccugccuugcucucgggggcgugaugaucuuucuguccacagccgucucugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10552 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagacaguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacaccaaaaacggcagcaucucccuuaugugccucgcccucgggggcgugcugaucuuucugucuaccgcugugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10553 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacaucguccucgagcauggcgggugugugaccguuauggcccaggauaaacccacgguggacauugaacuggucaccacaaccgugagcaauauggcugaggugcgcucuuauugcuacgaggccuccaucagcgauauggcuucugacuccagauguccuacacagggagaagccuaucuugauaagcaaagcgacacccaguacgucugcaaacggacgcugguugaucgcggcuggggcaacggguguggacucuucggcaaggggucucuggugacaugcgcgaaguuugccuguuccaaaaagaugaccggaaaaagcauucagcccgagaaucuugaauauagaaucaugcuguccgugcacggcucucagcauagcgggaugauugucaacgacacaggacacgagaccgaugagaaucgggcuaagguggaaaucaccccuaacagcccccgcgccgaggcuacacucggcggcuucgggucccugggacuggacugcgaaccuagaacgggccucgauuuuucugaccuguacuaccuuaccaugaauaacaaacacuggcugguucauaaggagugguuccacgacaucccgcuccccuggcaugccggggccgauacaggaaccccucacuggaauaacaaggaagcucugguggaguuuaaagacgcgcacgccaagcggcaaacagucgugguucuuggcucccaggagggggcugugcauaccgcccuggccggagcucucgaagccgagauggauggcgcgaaaggccgccugagcucugggcaccugaaguguagacucaaaauggacaagcugcggcuuaaaggagucagcuauucccugugcacggcugccuucacauuuaccaagauucccgccgaaacccuccauggcacagugaccgucgaggugcaguacgcugggacagauggaccuuguaagguucccgcccagauggcuguggacaugcaaacgcugaccccggucggcagacuuaucacagccaauccugugauuaccgaaucuacagagaacagcaaaaugaugcuggagcucgaucccccuuucggggacuccuauaucguuauuggcgugggagaaaagaaaaucacccaccauuggcaccgcagcggcucuacgaucgggaaggcguuugaggccaccguccggggagcuaaaagaauggccgugcugggcgauacagcuugggacuucggguccgugggaggcgcccugaauagccucgggaagggcauucaccagaucuucggagcggccuuuaagucucuguucggcgggauguccugguuuagccagauucuuaucggaacccugcucauguggcugggccugaacacaaagaacggguccauuucucuuaugugccucgcucugggaggcguucugaucuuccucagcaccgccgucuccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10554 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaagcaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacgcuaaaaacggguccaucucucuuaugugccucgcccugggaggcguccugauuuuccucagcacagcuguguccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10555 - RNA, 2164 nt, Artificial Sequence
  ZIKV (strain MR 766) ME variant mRNA Design 2 opt
ggggcgcugccuacggagguggcagccaucuccuucucggcaucaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauuaagguggagaacuggaucuuucggaauccuggcuucgcucugguggccgucgccauugcuuggcuucuggggucuagcaccucccagaaagugaucuaucucguuaugauucugcugaucgccccggcuuacucuauccgcugcauuggagugagcaacagagauuuugucgaaggcauguccgggggaacauggguggacguugugcucgagcauggcgggugugucaccgugauggcccaggauaagcccacgguggacaucgaacuggucaccacaaccguuagcaauauggcggaggugcggucuuauugcuacgaggccuccauuagcgauauggcuucugacucccgcuguccuacacagggagaagccuaucuugauaaacaaagcgacacccaguacgugugcaagagaacgcuggucgaucggggcuggggcaacggguguggacucuucggcaaggggucucuggugacaugcgcuaaauuuaccuguuccaagaaaaugacaggaaagagcauccagcccgagaaucuugaauaucgcauuaugcuguccguucacggcucucagcauagcgggaugaucggauacgagaccgacgaggauagagccaaaguggaagucaccccuaacagcccccgggcggaggccacacucggcggcuucgggucccugggacuggacugcgaaccucgcacgggccucgauuuuucugaccuguacuaucuuaccaugaauaacaagcacuggcuggugcacaaggagugguuccaugacauuccgcuccccuggcacgcuggggccgauacaggaaccccucauuggaauaacaaagaagcucugguugaguuuaaggacgcccacgccaaaagacaaacaguggucgugcuuggcucccaggagggggcuguccacaccgcgcuggccggagcucucgaagccgagauggauggcgccaagggccggcuguucagcgggcaucugaaaugucgccucaagauggacaaacugagacuuaagggagugucuuacagccugugcacggcugccuuuacauucaccaagguucccgcggaaacccuccacggcacagugaccgucgaggugcaguaugcugggacagauggaccuuguaaaauccccguucagauggccguggacaugcaaacgcugaccccggucggccggcuuaucacagccaauccugugauuaccgaauccacagagaacucuaagaugaugcuggagcucgaucccccuuuuggggacagcuacaucgugauuggcguuggagauaaaaagaucacccaucacuggcauagauccggcagcacgauugggaaggcuuucgaagccaccguccgcggagcuaagcggauggccgugcugggcgacacagcgugggauuucgggucugugggaggcgucuuuaauucccuggggaagggcauccaccagaucuucggagccgcuuuuaaaagccucuucggcgggaugucuugguuuucccagauucugaucggaacccuucugguguggcucggccugaacacaaagaaugggagcauuucccugaccugccuugcccucggaggcguuaugaucuuccugucuacggcugugagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10556 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacacaaagaacggguccaucucucuuaugugccucgcucugggaggcguccugauuuuccucagcaccgccguguccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10557 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggauauuguccucgagcacggcggcugcgugaccguuauggcucaggacaagcccacaguggauaucgaacuggucaccacgaccguguccaauauggccgaggugcgcagcuauuguuacgaggcgucuauuuccgacauggccagcgauucuagaugcccuacacagggggaggcuuaucuugacaaacaauccgauacccaguacgucuguaagcggacacugguugaccgcggauggggcaacgggugcggacucuuuggcaaggggagccuggugaccugugccaaauucgcuugcuccaagaaaaugacgggaaagucuauccagcccgaaaaucuugaauauagaauuaugcugagcgugcauggcucccagcacagcggcaugaucgucaacgauacagggcaugagaccgacgagaaucgggccaaaguggaaaucacaccuaacucuccccgcgccgaggcuacccucggaggcuuugggucccugggacuggauugugaaccuagaaccggccucgacuucagcgaucuguacuaccuuacaaugaauaacaagcacuggcugguucacaaggagugguuucaugacauuccgcuccccuggcacgcgggggccgacacgggaaccccucauuggaauaacaaagaagcucugguggaguucaaggaugcccacgccaaacggcaaacagucgugguucuuggcucucaggagggcgcugugcacaccgcccuggcgggggcucucgaagccgagauggacggagccaagggccgccugagcuccgggcaucugaaaugcagacucaagauggauaaacugcggcuuaagggagucucuuauagccuguguacagcugccuuuaccuucacgaagauccccgcugaaacacuccacggcaccgugaccgucgaggugcaguacgccgggacagacggcccuugcaaaguucccgcgcagauggccguggauaugcaaacccugacaccggucggaagacuuauuacggcuaauccugugaucaccgaauccacagagaacagcaagaugaugcuggagcucgaucccccuuuuggcgacucuuauauuguuaucggggugggagagaaaaagaucacccaucacuggcaucgcuccggcagcacaauugggaaagccuucgaagcuaccguccggggagccaagagaauggcggugcugggcgacacggccugggauuuugggucugugggcggagcucucaauucccugggcaaggggauccaccagauuuucggagccgcuuucaaaagccuguuuggcgggauguccugguucucucagauccuuauuggaacccugcucauguggcugggccugaacacaaagaacgggagcaucucccuuaugugccucgcccugggcggaguucugaucuuucucucuaccgccgucagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10558 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacgccaagaacgggagcauuucccuuaugugccucgcccugggcggaguccugaucuuucucucuacagcugugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10559 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucaucaaaguggagaacuggauuuuccggaauccuggcuuugcucugguggccgucgcuaucgccuggcuucugggguccucuaccagccagaaggugauuuaucucguuaugauccugcugaucgcgccggccuacuccauucgcuguaucggagugagcaacagagacuucgucgaaggcaugucugggggaacauggguggauguugugcucgagcacggcggcugcgucaccgugauggcucaggacaaacccacaguggauauugaacuggucaccacgaccguuuccaauauggccgaggugcggagcuauuguuacgaggcuucuaucuccgacauggccagcgauucucgcugcccuacacagggggaagcguaucuugacaagcaauccgauacccaguacguguguaagagaacacuggucgaccggggauggggcaacgggugcggacucuuuggcaaagggagccuggugaccugugccaaguucacgugcuccaaaaagaugacaggaaaaucuauucagcccgagaaucuugaauaucgcaucaugcugagcguucauggcucccagcacagcggcaugauuggguacgagaccgaugaggacagagcuaagguggaagucacaccuaacucuccccgggccgaggcuacccucggaggcuuugggucccugggacuggauugugaaccucgcaccggccucgacuucagcgaucuguacuaucuuacaaugaauaacaagcauuggcuggugcacaaagagugguuucacgacaucccgcuccccuggcaugccggggccgacacgggaaccccucacuggaauaacaaggaagcucugguugaguucaaagaugcgcaugccaagagacaaacaguggucgugcuuggcucucaggagggcgcuguccacaccgcccuggccggggcucucgaagccgagauggacggagcgaaaggccggcuguuuagcgggcaccugaagugccgccucaaaauggauaagcugagacuuaagggaguguccuacucucuguguacagcugccuucaccuuuacgaaaguucccgccgaaacacuccauggcaccgugaccgucgaggugcaguaugcugggacagacggcccuugcaagauccccguucagauggccguggauaugcaaacccugacaccggucggacggcuuauuacggcuaauccugugaucaccgaaagcacagagaacuccaaaaugaugcuggagcucgaucccccuuucggcgacagcuacauugugaucgggguuggagacaagaaaauuacccaccauuggcacagaucuggcuccacaaucgggaaggccuuugaagcgaccguccgcggagccaagcggauggcugugcugggcgauacggccugggacuucgggagcgugggcggagucuucaauucucugggcaaagggauccaucagauuuuuggagcugccuucaagucccucuuuggcgggaugagcugguucucccagauccugauuggaacccuucugguguggcucggccugaacaccaaaaaugggucuaucagccugacaugccuugcgcucggcggaguuaugauuuuucuguccacagccgugucugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10560 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacacaaagaacgggagcauuucccuuaugugccucgcccugggcggaguccugaucuuucucucuaccgccgugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10561 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggcaauaagcggaguaccaguuuuagguuucuuuauaauagcugucuuaaugucagcacaggaaucaugggcaguaacuagaagagggucagccuauuauauguaccuagauagaaaugacgcuggugaagcgauaaguuuuccaaccacuuuaggcaugaauaaaugcuauauacaaauaauggaccuuggacauaugugcgaugcuacaaugucauacgaaugcccaauguuagaugaagguguagaaccagaugacguagauugcugguguaauacaacgaguacauggguaguauauggaacuugccaucauaagaaaggagaagcaagaagaucaaggagagcaguuacauuaccaucucauucuacuagaaaacuacaaaccagaucucaaacuugguuagaaaguagagaauacacaaaacaucuaauaagaguagaaaauuggaucuuuagaaauccaggauuugcauuagcagcagcagcaauagcauggcuauuaggaagcucaacaagucaaaaaguaauauacuuaguaaugauacuucuaauagcaccagcauauucaauaagauguauagguguaucaaauagagauuuugucgaaggaaugucaggugguacauggguagauauagucuuagaacacggaggaugugucacaguuauggcucaagauaaaccaacaguagauauugagcuaguaacaacgacaguaucaaacauggccgaagucagaucauacuguuaugaagcaucaauaagcgacauggcaagugauaguagauguccgacacaaggagaagcauaucuagacaaacaaucagauacacaguauguaugcaaaagaacauuaguagauagaggcuggggaaacgguugcggauuauuugguaaaggcagccucguaacaugcgcaaaauuugcaugcucgaagaaaaugacagguaaaaguauacaaccagaaaaccuagaauacagaaucauguuaaguguucaugguagucaacauaguggaaugauaguuaacgauacaggacacgaaacugaugaaaauagagcaaaaguagaaauaacaccuaauucuccaagagcagaagcaacacuagggggauuugguucauuaggauuagacugugaaccaagaacagguuuagauuuuucagauuuauauuaccucacaaugaauaacaaacauugguuaguacauaaagaaugguuucaugauauuccauugccuuggcaugccggugcagacacaggcacaccacauuggaauaauaaggaagcacuuguggaauuuaaagaugcacaugcaaaaagacaaacaguuguaguacucgguucacaagaaggagcaguacacaccgcauuagcaggcgcacucgaggcagaaauggauggggcaaaagggagacuaaguaguggacaucugaaaugcagauuaaaaauggacaaacuacgacuaaaaggaguaucauauagucuuugcacagccgcguucacguucacuaaaauaccugcugaaacauuacacggaacgguaacuguagaaguacaauaugcaggaacagauggaccaugcaaaguuccugcgcaaauggcagucgacaugcaaacauuaacaccaguagggagguuaauuacagcuaauccaguuauaacagaaaguacagagaauaguaaaaugaugcuagaauuagauccaccuuuuggggacucuuacauaguaauaggaguaggagaaaagaaaauaacccaucauuggcaucgaaguggaaguacaauaggaaaagcauuugaggcaacaguaagaggagcaaaaagaauggcaguacuuggagauacagccugggacuucggcagugucggaggagcacuaaauaguuuaggaaaagguauacaucaaauuuuuggagccgccuuuaaaucauuauucggagggauguccugguuuagucaaauauuaauuggcacauuauuaauguggcuaggauuaaauaccaaaaauggcucaauaucauuaauguguuuagcguuagguggaguacuaaucuuuuugagcacggcagucagugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10562 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggcuauaagcggaguaccaguccuagguuucuuuauaaucgcugucuuaaugucagcacaagaaucgugggccguaaccagaagaggaagugcauauuauauguauuuagaccgaaaugaugcaggcgaagcgauaucauuuccaacgacauuaggaaugaauaaauguuauauacaaauaauggauuuaggacacacaugcgaugcaaccaugucuuacgaauguccaauguuagacgaaggaguagaaccagaugacguagacuguugguguaauacaaccaguaccuggguaguuuacggaacaugucaucacaagaaaggagaagcaagaagaaguagacgagcaguaaccuugccaucacauucaacaagaaaauuacaaacaagaucacaaacaugguuagaaagucgagaauauacaaaacaucuaauaagaguagaaaacuggauauuuaggaacccuggauuugcacucgcagcagcugcaauugcaugguugcuaggaagcucuacuucccaaaaaguuauuuauuuaguaaugauauuauuaauagcaccagcauauucaauuagauguaucgguguaucuaauagagacuuuguagaaggaaugagcggagguacuuggguagaugucguauuagaacauggaggauguguaacaguaauggcccaagauaaaccaacgguagacauagaauuagucacuacaacuguuucaaauauggcugaaguuagaucauacuguuaugaagcaaguauaucagauauggccagugacuccagauguccaacccaaggagaagcauauuuagacaaacaaagugacacacaauauguaugcaaaagaacucuaguagauagaggcuggggaaauggaugcggauuauuuggaaaggggaguuuaguaacaugcgcaaaauuugcaugcucaaagaaaaugacaggaaaaaguauccaaccagaaaauuuagaauauagaauaauguuaucaguacauggaucgcagcacagcggaaugauuguuaacgacacaggacaugaaacagaugaaaacagagcaaaaguugaaauuacaccaaacucaccaagagcagaagcgacauuaggaggauuuggaucacuagguuuagauugugaacccagaacuggacuugauuucagugacuuauauuaucuuacgaugaauaauaaacacuggcuaguucacaaagaaugguuucaugauauaccacuuccauggcaugcaggagcagauaccggcacaccucacuggaacaauaaagaggcccuaguagaauuuaaagacgcucaugcaaaaagacagacuguugugguauuaggcucacaagaaggagcaguucacacugcgcuagcaggggccuuagaggcagaaauggacggcgcaaaagguagacucucaagcggacauuuaaaaugcagacugaaaauggauaaauuacgacuaaaaggaguuaguuauagccuauguacugccgcauuuacuuucacaaaaauaccagcagaaacacugcauggaacuguaacgguagaaguacaauacgccgguacagacggaccuuguaaaguaccagcacaaauggccguagauaugcaaacacuaacuccuguugguagacuaauaacugcaaauccuguaauaacagaaagcacagaaaauucaaaaaugauguuagaauuagauccaccuuuuggagauucauauauaguaaucgggguuggagaaaagaaaauuacacaccauuggcaucgaucaggaucaacaaucgguaaagccuuugaagcgacaguaagaggugcaaaaagaauggcaguauuaggagauacagcaugggauuuugguucgguaggaggagcauuaaauucacuaggaaaagguauucaccaaauauuuggagcagccuuuaaaaguuuauuuggaggaaugaguugguuuagucaaauuuugauaggaaccuuauuaauguggcuuggacucaacgcaaagaacggaucaauuagcuuaaugugucuagcguuaggaggaguuuugauauuccuaucaacagcaguaagugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10563 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccauaucaggaguaccaguauuagguuuuuucauaauagcaguacucaugucagcacaagaaucaugggcgauaacaagaagaggaucagcauauuacauguauuuagauagaucagaugcgggaaaagcaauuuccuuugcaacaacauuaggugugaacaaaugccauguacaaauuauggaucuuggucacaugugcgacgcaacaaugucguacgaaugcccuaugcuugacgaaggaguugaaccagaugacgucgauuguugguguaacacaaccucaacauggguugucuacgguacuugucaucauaaaaaaggggaagcaaggagaucaagaagagcuguaacacuaccaagucauucaacuagaaaauuacaaacaagaagccaaacauggcuagaaucucgagaauauaccaaacacuuaauaaaaguagaaaacuggauauuuaggaauccaggauucgcauuagucgccguagccauugccugguuacugggaucuaguacaagccaaaaagucauuuaccuaguaaugauacuuuuaauagcaccagcauacucaauucgguguauaggugucaguaacagggauuuuguugaagguaugaguggaggaacauggguagauguuguacucgaacacggcggaugugucacaguaauggcacaagauaaaccaacuguagacauagaacuaguaacaacaacuguaucaaacauggcggaaguuagaucauacuguuaugaagcaaguauaucagauauggcaucagauucacgcugcccaacacaaggcgaagcauauuuagauaaacaaagcgauacacaauauguaugcaaacgaacacuaguagacagaggcuggggcaauggaugcggauuauucggcaaaggaagucuuguaaccugugcaaaauuuacaugcucaaaaaaaaugacagguaaaaguauacaaccagaaaaucuagaauaucgaauaauguuaagcguacauggaucacaacauucuggaaugauuggauaugaaacggaugaagauagagcaaaaguagaaguaacaccaaauuccccaagagcagaagccacacuagguggcuuuggaucucuaggcuuagauugugaaccaagaacuggauuagauuuuucagauuuauauuauuugacaaugaauaauaaacauugguugguacauaaagaaugguuucacgauauaccuuuaccauggcaugcuggagcagacacaggaaccccacauuggaacaauaaagaagcauuagucgaguucaaagaugcccaugcaaaaagacaaacgguaguaguucuaggaucccaagaaggagcgguacauacagcacucgcaggagcacuagaagccgaaauggauggugcuaaaggaagauuauuuucaggacaucuuaaauguagauuaaaaauggauaaauuaagacuuaaaggaguaucuuauagucucuguacugcggcuuuuacauuuacaaaaguaccagcagaaacguuacaugguacaguaacaguagaaguacaauacgcaggaacagacgguccauguaaaauuccuguacaaauggcaguagauaugcaaacucugacaccaguagguagauuaauaacagcuaauccuguaauaacagagucaaccgagaacucaaaaaugaugcuagaauuagauccaccuuuuggagauucauauauagucauaggcguaggagacaaaaaaauaacacaucacuggcacagaucaggaaguacuauagggaaggcauuugaagcaacgguaagaggcgcaaaaagaauggcaguauuaggagauaccgcaugggauuuuggaaguguuggugguguguuuaacucuuuagggaaagggauacaucaaauauuuggagcagcauuuaaaagcuuguuuggagguaugucaugguuuucacaaauacuaauaggaacauugcuaguaugguuaggauuaaauacuaaaaauggaagcauaagcuuaacaugcuuagcauuagguggaguaaugauauuuuuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10564 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggcuauuucugggguuccaguauuaggauucuuuauaauagcaguauuaaugucagcacaagaaaguugggcaguaacaagaagaggaagugcauacuauauguauuuggacagaaaugacgcuggagaagccauaaguuuuccaacaacauugggcaugaacaaauguuauauacaaauaauggauuuaggacauaugugugaugcaacaaugucauacgaauguccuaugcuagaugaaggagucgaaccagacgauguagauuguuggugcaauacaacuucaacauggguaguuuauggaaccugucaucauaagaaaggggaagcaagaaggaguagaagggcaguaacuuuacccucucauagcacaagaaaauuacaaacaagaucacaaacuuggcucgaaagcagagaauauacuaaacauuuaauaagaguagaaaauuggauuuucagaaauccaggauuugcucuagcagcagcagcaauagcaugguuacuugguuccaguacaagucaaaaaguaaucuaccuuguaaugauacuucuuauugcuccagcguauucaauaagguguauuggaguaaguaacagagacuucguagaagguaugucuggaggcacguggguagacguaguauuagaacacgguggguguguaacuguaauggcucaagauaaaccaacuguugauaucgaauuagugacaacaacaguuucaaacauggcugaaguacgaagcuacugcuacgaagcaucaauaagugauauggcaagugauagucgaugcccaacacaaggagaagcauaucuagacaaacaaagugauacacaauauguauguaaaagaacacuuguagauagaggauggggaaaugguugugggcuauuuggcaaagggagcuuagucaccugugcaaaauuugcuuguagcaagaaaaugacaggaaaaagcauacaaccagaaaaucuagaauauagaauaauguuaaguguccauggaucacaacauaguggaaugauaguaaaugacaccggacacgaaacugacgaaaaucgagcaaaaguggaaauaacaccaaauagucccagggccgaagcuacauuaggagguuuuggaucacuaggacuggauugugaacccaggacaggguuagauuucagcgauuuauauuauuuaacaaugaacaauaaacauugguugguacauaaagaaugguuucaugauauaccauuacccuggcaugcuggugcugauacaggcacaccucauuggaacaauaaagaagcauuaguagaauuuaaagaugcgcaugcaaaaagacaaacaguugucguuuuaggaagucaagaaggcgcaguacauacugcucuagcaggagcauuagaagcugaaauggauggagcaaaaggcagacugucaaguggacauuuaaaaugucgacuaaaaauggauaaauugcgauuaaaaggaguaucauauuccuuaugcacugcagcuuuuacauuuacaaaaauaccugcagaaacguuacauggaacaguuacaguagaaguucaauacgccggaacagauggaccauguaaaguaccagcacaaauggcaguagacaugcaaacauuaacaccugucggacgacuaaucacagcaaauccaguuauuacagaaucaacagaaaauaguaaaaugaugcuagaauuagauccaccauucggagauucauacauaguaauaggaguuggagaaaagaaaauaacacaccauuggcaucgaagcggaaguacaauaggaaaagcguucgaagcuacaguccguggagcaaaaagaauggcaguauuaggagauaccgcaugggauuuuggaaguguaggcggagcauuaaauaguuuaggaaaagguauacaccaaaucuuuggagcagcauucaaaucacuauuuggaggaaugagcugguuuucgcagauacugauagguacuuuauuaauguggcuaggauuaaauacgaaaaacgguagcauaucauugauguguuuagcacucgguggaguacuaauauuuuuaucuacagcuguauccgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10565 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggauuggacauggauuuuauuucuagucgcagcagcuacaagaguacacuccguaacaagaagaggaucggcauacuauauguauuuagacagaaacgaugcaggggaagcaauaucauuuccaacaacucuugguaugaauaaauguuacauacagauaauggauuuaggacacaugugcgaugccacuaugucguacgagugcccaauguuagacgaagggguggagccggaugauguagauugcugguguaacacuaccucuacauggguagucuauggaacaugucaccacaagaaaggagaagcaagaagaaguagacgagcaguaaccuuaccaagucauucaacaagaaaauuacaaacaagaucacaaacaugguuagaaucaagggaauauacaaaacauuuaauuagaguagaaaacuggauauuuagaaauccugguuuugcuuuggcagcagccgcuaucgcuugguuauuaggaagcagcacaucacaaaaaguaauauauuugguaaugauuuuacucauagcccccgcguauaguauucgauguauagguguaucuaauagagacuucguagaaggaaugucaggaggaacuuggguagacaucguauuagaacacggaggauguguaacaguaauggcucaagacaaaccgacaguagauauagaauugguaacaacaacuguuucuaauauggcagagguacgaucauacuguuaugaagcaagcaucagugauauggcuucagacagccgauguccaacacaaggugaagcauacuuagauaaacaaagcgacacacaauauguaugcaaaagaacguuaguagauagaggcuggggaaaugguugcggguuauucggaaaaggaucauugguaacaugcgcaaaauuugcauguucaaagaaaaugacuggaaaaucuauacaaccugaaaaucuagaauauaggauaauguuaaguguucauggaucucaacacucaggaaugauaguaaaugacacaggacacgaaacggaugaaaauagagccaaaguagaaauaacaccaaauucaccgagagcagaagcgacauugggaggauuugggucacuaggauuagauugugaaccgagaaccggguuagauuuuucugaucucuauuaucuaacaaugaauaauaaacauugguuaguacacaaagaaugguuccaugauauuccauuaccuuggcacgcaggagccgauacagguacuccacacuggaacaauaaagaagcauuaguagaauuuaaagacgcacaugcaaaaagacaaacaguaguaguauuaggaagucaagaaggcgcaguacacaccgcucuagcaggagccuuagaagcagaaauggauggagcaaaggguagauugucuucaggccaucuaaaauguagacuaaaaauggauaaacuaagauuaaaaggaguaagcuacucuuuaugcacagcagcauuuacguuuacaaaaauaccagcagaaaccuuacauggaacuguuacuguagaaguacaauaugcaggaacagauggaccauguaaaguuccagcacaaauggcaguagauaugcaaacauuaacaccaguaggaagauuaauuacagcaaauccaguaauuacagaaucaaccgaaaacucaaaaaugauguuagaauuagacccaccuuucggagacucauauauaguaauaggaguaggagaaaagaaaauuacacaccauuggcaccgauccggaucaacaauaggaaaagcauucgaagcuacaguacgaggcgcaaaaaggauggcagucuuaggagauacagcaugggauuuuggaagcguaggaggagcacuuaacuccuuagguaaaggcauacaucaaauauuuggagcagcguuuaaaucauuauuuggggguaugucuugguuuagccaaauacucauagguaccuuauuaauguggcuaggacuuaauacuaaaaacgguucaauuucauuaauguguuuagccuuaggagguguuuuaauauuucuuaguacagcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10566 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggauuggacauggauauuauuuuuaguggcagcagcaacaagagugcacucagugaccaggagaggaagugcauauuauauguauuuagauagaaaugacgcgggagaagcaauaucauucccaacuacguuaggaaugaauaaauguuauauacaaauaauggauuuaggucauacaugugaugcaacaaugucuuacgaauguccgauguuagacgaaggaguagaaccagaugacguagacugcuggugcaauacaacaaguacuuggguaguauacggaacaugccaucacaaaaaaggagaagcuagaagaucucgaagggcaguaacuuuaccaagucauucuacacgaaaauugcaaaccaggucacaaacaugguuagaaucaagggaauacacaaaacaucugauaagaguagaaaacuggauauuuagaaaucccggguuugcauuagcugcagcagcaauagcauggcuuuuagguucaucaacaucucaaaaaguaauauaucuugugaugauacucuuaauugcaccugcuuacaguauuagguguauaggugucucaaauagagacuuugucgaagggaugaguggugguacauggguugauguugucuuggaacaugguggauguguaacaguaauggcacaagauaaaccaaccguagauauagaauuagucacaacgacaguaucuaacauggcagaaguuagaucuuauugcuaugaagcgucaauaucugauauggccucggacucaagaugcccaacacaaggcgaagcauaucuagauaaacaaucagauacccaguauguauguaaaagaacauuaguugauagagguuggggaaaugguugcggacuauuuggcaaaggaucauuaguaacaugugcaaaauucgcauguagcaaaaaaaugacaggaaaaucaauucaaccagaaaauuuggaguauagaauaaugcuaagugugcacggaagccagcauaguggaaugauuguaaaugauacaggacaugaaacugacgagaauagagcgaaaguagaaaucacaccaaauucaccaagagcugaagcuacacuaggaggauuugguaguuuaggccucgauugugaaccaagaacaggauuagacuucuccgaucuauauuauuuaacaaugaauaauaaacacuggcuaguucauaaagaaugguuucaugauauaccuuuaccuuggcaugcaggagcagauacaggaacuccucauuggaacaauaaagaagcacuaguagaauuuaaagaugcacacgcaaaaagacaaacaguagucguacuaggaagucaagaaggagcaguucauacagcuuuagcaggagcauuagaagcagaaauggauggagcaaaagggagauuaucaucaggacaccuaaaauguagauuaaaaauggauaaauuaagauuaaaaggaguaucauacucauuguguacagcagcauuuacauuuacaaaaauaccagcagaaacauuacauggaacagucacgguugaaguacaauacgccggaaccgacggaccaugcaaaguaccugcacaaauggcaguagauaugcaaacacuaacaccaguaggacgacuaauaaccgcgaauccaguaauaacagaaaguacagaaaauagcaaaaugauguuagaacuagauccuccauuuggagauucauacauaguaauuggagucggggaaaaaaagauuacucaccacuggcaucgaucgggcaguacaauaggaaaagcauuugaagcaacaguacgcggagcaaaaagaauggcaguacuaggagacaccgcaugggauuucgguucaguagguggagcauuaaauucauuagguaaaggaauacaccaaauauucggagccgccuuuaaaaguuuguuuggcggaaugaguugguuuagccaaauauugaucggaaccuuacuaauguggcuggguuuaaaugcaaaaaaugguagcauaagucuaaugugcuuagcacuggguggaguacuaauauuuuuaucaacggcaguaucagcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10567 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggauuggaccuggauauuauuuuuaguagcagcagcuacuagggugcauucaauaacaagaagaggaucagcuuacuauauguauuuagacagaagcgacgcaggaaaagcaaucagcuuugcuacaacacuagguguaaauaaaugucauguacaaauaauggauuuaggacauaugugugaugcaacaaugaguuacgaauguccuauguuagaugaagguguggaaccugacgauguagauuguuggugcaauacuacuagcacuuggguagucuauggcacaugucaucauaagaaaggcgaagcaaggagaaguagacgugcaguaacauugccaucucacaguacacgaaaauuacaaacuagaucacagacauggcuugaaucaagagaauauacaaaacacuuaauaaaaguagaaaauuggauauucagaaauccuggguucgcacuuguggcugucgcuauagcuugguuacuaggaaguaguacgagucaaaaaguuauauaucuuguuaugauauuacuaauagcaccagcauacaguauaagauguauagggguuucuaacagagacuuuguugaaggaaugucagguggaacauggguagacguaguauuagaacacggaggauguguaacuguaauggcacaagauaaaccaacuguugauaucgaacucguaacaacaacagugagcaauauggcggaagugagaucauacuguuaugaggcaucaaucucagacauggcaucagauucaagauguccaacucaaggugaagcguaucuggacaaacaaucagacacacaauauguauguaaaaggacauuaguugauagaggaugggguaauggaugcggacuauucggaaaagggagcuuaguaaccugugcuaaauuuacauguaguaaaaagaugacaggaaaaucaauacaaccagaaaauuuagaauacagaauaaugcuaucaguccauggcagucaacacagcggaaugauugguuaugaaacggacgaggauagagcuaaaguugaaguaacgccuaauaguccuagagcagaagcuacacuaggaggauuuggaucacuaggauuagacugcgaaccacgaacaggauuagauuuuagugauuuauauuaccuaacgaugaauaacaaacacugguuaguacacaaagaaugguuucacgauauaccauuaccauggcaugcaggcgcugauacaggaacaccacauuggaacaauaaagaggcuuugguagaauuuaaagacgcacaugcuaaaaggcagacaguaguaguauuaggaucacaagaaggagcugugcauacagcacuugcaggagcacuagaagcagaaauggacggggcaaaaggacgauuguucucaggacauuuaaaguguagacuaaaaauggauaaacuaagacuaaaagguguaucauauagccuauguacugccgcauuuacguuuacuaaagucccagcagaaacucuacauggaaccguaacugucgaagugcaauaugcagguacagauggcccuuguaaaauaccaguucaaauggcaguggacaugcaaacauuaacaccgguaggaagauuaauaacagcaaauccgguuauaacggaaucaacagaaaauaguaaaaugaugcuagaauuggauccaccauuuggugauucauauauaguaauaggcguaggagacaagaaaauaacacaucacuggcauagaagcggaucaacaauagguaaagcauuugaagcuacuguaagaggagcaaaaagaauggcaguccuaggugauacagcuugggacuuugguagcguaggaggaguguuuaauucacucggaaaagguauucaccaaaucuuuggagccgcuuuuaaaucauuauucggagguaugagcugguucucacaaauccuaauaggaacacuauuagugugguugggacuaaauacuaaaaaugguagcauaucacuaacauguuuagcauuaggagggguuaugauauuucuaaguacagcuguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10568 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggauuggacauggauauuauuuuuaguagcagcagcaacgagaguacauaguguaacaagacgagguuccgcauacuacauguauuuagauagaaaugaugcgggagaagccauaucauucccgacgacauuaggaaugaauaaauguuauauccaaauaauggauuuaggacacaugugugaugcaacaaugucauaugaauguccaauguuagacgaaggaguugaaccugaugauguagauuguugguguaacacaacuagcacguggguugucuauggaacaugucaucauaagaaaggagaagcaagacggaguaggagagcaguaacauugccaucacacaguacaagaaaacuacaaacacgaagucaaacaugguuagagagccgagaauauacaaaacaucuaauaagaguagaaaauuggauuuucagaaauccagguuuugcauuagcagcagcagcaauagccugguuauuaggaucaucaacaagucaaaaaguaauauauuuagucaugaucuuauuaauagcaccagcguauucaauacgauguauuggaguaucuaacagggauuucguagaagguaugucaggaggaacauggguagauguaguacuugagcauggaggaugugugacaguaauggcacaagauaaaccaacgguugauauagaauuaguaacaacaacaguaucaaacauggcagaaguaagaaguuauugcuaugaagcaagcauaucagauauggcuucugacagucgauguccaacacaaggagaagcauauuuagacaaacaaucugauacucaauaugucugcaaaagaacauugguagauaggggguggggaaauggauguggauuguuuggaaaaggaagucuaguaacgugugcaaaauuugcuugcucgaaaaaaaugacuggaaaaaguauacaaccagaaaaucuugaauauagaauaauguuaaguguucauggaagucaacauucaggaaugauuguaaaugauacuggacaugaaacggacgaaaauagggccaaaguagaaauaacaccuaauaguccuagagcugaagccacauuaggaggauucggaucauuaggacucgacugugaaccaaggacaggacuagauuucucugacuuguauuacuuaacaaugaauaauaaacauugguuaguacacaaagaaugguuucacgauauaccacuaccauggcaugcgggagcugauacagguacuccacacuggaauaauaaagaagcacucguagaauuuaaagacgcacacgcaaaaagacaaacaguuguaguauuagguucacaagagggcgcaguacauacagcauuagcaggugcuuuagaagcugaaauggacggagcaaaaggaagauuaucaaguggacaccuaaaaugcagauugaaaauggauaaauuacgauuaaaaggaguaucuuauagccuuuguacugccgcauuuaccuuuacaaaaauaccagcagaaacauuacauggaacuguaacaguagaaguacaauacgcuggcacugacggaccauguaaaguaccggcucaaauggcgguagauaugcaaacauuaacaccaguaggucgccuaauaacagcaaauccaguaauaacugaaagcacugagaauuccaaaaugauguuagaauuggauccaccuuuuggagauucauacauaguaauuggaguaggugaaaaaaaaauaacacaucacuggcauagauccggaucaacaauaggaaaagcauuugaagcaacaguucguggggcuaaaagaauggcaguacuaggagauacagccugggauuucggaucgguaggaggugcauuaaacucauuaggaaaagguauacaucaaauauuuggagcagccuucaaaagucucuuuggaggcaugaguugguucagucaaauauugauaggaacucuauuaauguggcucggcuuaaauacaaaaaaugguucaauuucauuaauguguuuagcauuaggaggaguauuaauuuucuuaucaaccgcaguauccgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10569 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggaaaaagaucagcuggaaguauaaugugguuagcaucauuagcuguaguaauagcaugcgcaggagcuguaacaagaagaggaagcgcauauuauauguaccuagauagaaacgacgcaggagaagcuaucucuuuuccaacaacauuaggaaugaauaaauguuauauacaaauuauggauuuaggacauaugugcgacgcaacaaugucauaugaauguccuauguuagacgaaggaguagaaccagacgauguagauuguugguguaauacaacaaguacuuggguaguuuauggcacaugccaucauaagaaaggggaagcucgaagaagcagacgagcaguaacauuaccaagucauagcacaagaaaacuacaaacaagaagccaaacaugguuagaaucuagagaauauacuaaacauuuaauacgcguagaaaacuggauauucagaaauccaggauuugcacuagcagcagcagcaauagcaugguuauuaggaucaaguacaucacaaaaaguaauauacuuaguaaugauacuauuaauagcaccagcuuacucaauaagaugcauaggaguaucaaaucgugacuuuguagaaggcaugagcgggggcacauggguagauauuguacuagaacauggugguuguguuacaguuauggcucaagauaaaccuaccguugauauagaguuaguaacaacaacaguaagcaauauggcagaaguaagaucauacuguuacgaagcaucaauaagcgauauggcaucagauaguagaugcccaacucaaggagaagcauacuuagauaaacaaucagauacacaauauguaugcaagcgaacccuaguggaccgaggauggggaaauggauguggacuauuuggaaaaggcucucuuguuacaugugcaaaauuugcauguucuaagaaaaugacaggaaaaucaauacaaccugaaaacuuagaauacagaauaauguuaagcguucauggaagucaacacucagguaugauaguaaaugauacaggacacgagaccgaugaaaacagagcaaaaguagaaauaacacccaacucaccaagagcagaagcaacccuuggcgguuuuggaaguuuaggauuagauugugagccuagaacugguuuagauuucucagauuuauauuauuuaacuaugaauaauaaacauuggcuaguccauaaagaaugguuucaugauauaccuuugccauggcaugcgggugcagauaccggaacaccacacuggaacaacaaagaagcacuuguagaauuuaaagaugcccacgcaaaaagacaaacuguaguaguacuuggaagucaagaaggagcaguucauacugcauuagcaggagcauuagaagcagaaauggauggagccaaaggaagauuaaguucuggacaucuuaaauguagguuaaaaauggauaaauuaagacuaaaaggcguuucauacucauuauguacagcagcauucaccuucacaaaaauaccagcugaaacauuacacggaacaguaacaguugaaguucaauaugcaggaacugaugggccauguaaaguaccugcacaaauggcaguagauaugcaaacacuaacaccaguaggaagacuaauaacagcaaacccuguaauuacggaaucuacagaaaacagcaaaaugauguuagaguuggauccacccuuuggagauagcuauauaguuauaggagugggugaaaagaaaauaacgcaucauuggcacagaagugguaguacaauaggaaaagcauuugaggcaaccguaagaggggcaaaaaggauggcaguccuaggagacacagcuugggacuuuggaagcguaggcggggcccuuaauuccuuaggaaagggaauacaccaaauauuuggagcagcauuuaaaucauuauucgguggcaugucuugguuuucucaaauacuaauaggaacauuauuaauguggcuuggacuaaauaccaaaaauggcucaaucucauuaaugugucuugcuuuaggagguguacuaauauuuuuaaguacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10570 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccauggguaaaagaucagcuggaucaauaaugugguuagccucacuagcaguuguuauagcaugugcuggagcgguaacuagaagagguagugccuauuacauguaccuagauagaaacgaugcaggagaagccauaucauuuccaacaacauuagguaugaauaaaugcuauauucaaauaauggauuuaggacacacaugugaugcaacaaugucuuaugaauguccaauguuagaugaaggaguugaaccagaugauguagauuguugguguaauacaacaaguacauggguuguauacggaacgugucaucauaaaaaaggagaagcacgaagaaguagacgagcugucacauuaccaagucauagcacucguaaauuacaaacaagaagucaaacuuggcuagaaagcagagaauauacgaagcaucuaauaaggguugaaaacuggauauucagaaacccaggauuugcuuuagcagcugcugcaauagcauggcuauuaggaagcucaacaagucaaaaagucauauauuuaguaaugauacuucuaauagcaccagcauacaguauuagaugcauaggaguaaguaauagggauuuuguagaaggaaugaguggagguacauggguugacguaguauuagaacauggaggauguguaacaguaauggcacaagacaaaccuacaguagacauagaauuaguaacaacuacaguuucuaauauggccgaaguacgaagcuauuguuaugaggcaucaauaucagauauggcaucagacucaagauguccaacucaaggggaagcguaucuagauaaacaauccgacacccaauacguauguaaacgaacacuuguagauagaggauggggaaacgguuguggauuauuugguaaagguaguuuaguaacuugcgcaaaauuugcauguucaaaaaagaugacaggcaaaucaauacaaccagaaaaccuggaauauagaauaauguuaucaguacauggcucacaacauagugguaugaucguuaacgauacuggacaugaaacagaugaaaaucgagcgaaaguagaaauaacgccaaauucaccuagagcugaagcaacauuaggaggauuugggagcuuaggacuugacugugaaccuagaacaggauuagauuucagcgaucuauacuaucuuacgaugaauaauaaacauuggcucguacacaaagagugguuucaugauauuccucuuccauggcacgcaggagcugauacugggacaccacauuggaauaauaaagaagcuuuaguagaauucaaagaugcacacgcaaaaagacaaacaguaguuguguuaggaucucaagaaggagcgguacauacagcauuagcaggagcccuagaagcagagauggauggagcaaaaggacgguuaucaucaggacaucuaaaauguagacuuaaaauggacaaauuaagacuaaaaggaguaucuuauucauuaugcacagcagcauuuaccuuuacaaaaauaccggcagaaacacuucauggaacaguuacaguagaaguacaauacgcaggaacagauggcccaugcaaagucccagcacaaauggcuguagauaugcaaacauuaacuccaguagguagacuuauaacagcaaauccgguaauaacagagucaacggaaaauucaaaaaugauguuagaacuagauccaccauuuggagacaguuacauaguuauuggcgucggagaaaaaaaaauaacacaucacuggcauaggagcggaaguacaauuggaaaagcauucgaagcuacaguuagaggagccaaaagaauggcuguauuaggagacacugcgugggacuuuggaaguguaggaggcgcauuaaauagcuuagguaaaggaauacaucaaauauuuggugcggcauucaaaucacuguucggaggaaugaguugguuuucacaaauacuaaucggaacuuuacuaaugugguuagguuuaaaugcaaaaaauggaucaauaaguuuaaugugccuggcauuaggaggaguauugauauuuuuaagcacagcagugucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10571 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggaaaaagaucagcagggaguauaaugugguuagcaagucuagcaguugucauagcgugcgcaggugcaaucacuagaagaggaagcgcauauuacauguauuuagauagaagugaugcaggaaaagcaauuucauuugcuacaacauuaggcgucaauaaaugucauguacaaaucauggauuuaggucauaugugugaugcaaccaugagcuacgaauguccaauguuagaugaaggaguagaaccugaugacguagacugcugguguaauacaacaaguacauggguaguauauggaacgugccaucacaaaaaaggagaagcaagaagaagccgaagagcggucacccuaccaagucauagcacuagaaaauuacaaacaaggagucaaacauggcuagaaagcagagaauauacaaaacacuuaauaaaaguagaaaauuggauauuucguaauccaggcuucgcacuaguagcaguagccauagcaugguugcuuggaucaucgacaagucaaaaaguuaucuauuuaguaaugauauuauuaauagcgccugcauacucaauacgauguauaggaguaucuaacagagauuucguagaaggaaugucuggagguacuuggguagauguaguucuggaacaugguggauguguuacuguaauggcccaagacaaaccaaccguagauauugaacuaguaacuacuacuguaagcaacauggcggaaguacgaucauauuguuacgaagcaaguauaagugauauggcaucagauucuagaugcccgacccagggagaagcauauuuagauaagcaaagugacacccaauacguauguaaaagaacauugguagauagaggauggggaaacggauguggauuauucggcaaaggaaguuuaguaacaugugcuaaauuuaccugcaguaaaaaaaugacaggcaaaaguauacaaccagaaaauuuagaauacagaauaaugcuaagcguacauggaucucaacauucaggaaugauaggauaugaaacagaugaagauagggcuaaaguagaagucacaccuaauagcccaagagcggaagcgacccuggguggguuuggaucauuaggauuagauugcgaaccgagaaccggauuagauuuuagugauuuauauuauuuaacaaugaacaauaaacauugguuagugcauaaagagugguuccaugacauaccacuaccauggcaugcaggugcagacacuggaacaccacauuggaauaauaaagaagcauuagucgaauucaaagaugcucaugcgaaaagacaaacaguagugguucuaggaucucaagaaggagcaguacacacagcauuagcaggagcgcuagaagcagaaauggauggcgcaaaaggaagauuauucagcggucauuuaaaauguagauuaaaaauggauaaauuaagacuuaaaggaguaucauauucucuaugcacagcagcauuuacuuuuacuaaaguaccagccgaaacauuacauggcacgguaacugucgagguacaauaugcagguacagacggaccuuguaaaauaccaguacaaauggcaguggauaugcaaacauuaacuccaguaggcaggcuaauaacagcuaauccaguaauaacagaaucaacugaaaacagcaaaaugauguuggaauuagauccaccauuuggcgauuccuauauaguaauagggguaggagauaaaaaaauaacacaccauuggcacaggaguggaaguacaauagggaaagcauuugaagcgacaguaagaggagcaaaaaggauggcaguacuaggagauacagcaugggauuuugguagcgugggagguguauuuaacucacuaggcaaggggauacaucaaauauuuggcgcagcauuuaaaagcuuauuuggaggaaugaguugguuuucacaaauucugauaggaacucuuuugguaugguuaggauuaaauacaaaaaacgguucuauaaguuuaacaugucuagcauuaggggguguaaugauauuucuaaguacugcaguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10572 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggaaaaagaucagcagguucaauaaugugguuagcaucauuagcgguaguaauagcaugugcaggagccguaacgcguagagguucagcuuauuauauguaucuugauagaaacgaugcuggugaagcaauaucauuuccaaccaccuuaggaaugaauaaauguuauauacaaauaauggaccuaggacauaugugugacgcgacaaugucauacgagugcccuauguuagacgaaggaguagaaccagaugacguagauuguugguguaauacaacgucaacguggguaguauauggcacaugccaccauaagaaaggugaagcucgcagaagcaggagagcaguuacauugccaagccauucgacuagaaaauugcaaaccagaagucaaacaugguuagaaaguagagaauauacuaaacaucugauacgaguagagaacuggauauuuagaaauccaggauucgcguuagcagcggcagcaauagccugguuauuaggaaguucaacaagucagaaaguaauauaucuaguaaugauacuauuaauugcuccugcauauucaauaagauguauaggaguaucaaauagagauuuuguagaaggaaugucuggcggaacuuggguagauguaguacuagaacacggggguugugucacuguaauggcacaagauaaaccaacaguggauauagaauuaguaaccacaacaguaaguaauauggcagaaguaagaucauauuguuaugaagcaaguauaagugacauggcaucagauagcagauguccaacacaaggcgaagcauacuuagauaaacaauccgacacacaauacguauguaaaagaacauuagucgauagaggauggggaaauggauguggauuauuuggaaaagggucauugguaacaugugcaaaauucgcauguagcaagaaaaugacuggaaaaucaauacaaccagaaaauuuggaauaucgaauaauguuaaguguacauggcucucaacauucagggaugauuguaaacgacacuggacaugaaacagaugaaaacagagcaaaaguagaaauaaccccgaauaguccuagagcagaagcaacacuagguggauuugggucauuagguuuggauugugaaccaagaacaggcuuagauuuuagugaccuauauuaccugacuaugaauaauaaacauuggcuaguacauaaagaaugguuucaugauauaccauuaccauggcacgcaggagcugauaccggaacuccacauuggaauaacaaagaagcauugguugaauuuaaagaugcucacgcaaaaagacaaaccguaguaguacuaggcucacaagaaggagcgguccauacagcacuagcaggagcacuagaagcagaaauggacggggcaaaaggaagguuaucaaguggacauuuaaaguguagacuaaaaauggacaaauuacgauuaaaaggaguaucauauucauuauguacagcagcauuuacuuuuacuaagaucccagcagaaacauugcacggaacaguaacuguagaaguucaauaugcaggaacugauggaccaugcaaaguaccugcucaaauggcuguugacaugcaaaccuuaacccccguaggacgauuaauaacagcaaauccgguuauaacagaaucaacugaaaauaguaaaaugauguuagaacuagauccaccauuuggugauaguuacauaguuauaggaguaggagaaaagaaaauaacacaucauuggcauaggagcggaucaacaauagggaaagcauuugaagcaacaguaagaggagccaaaagaauggcaguauuaggagauacggcgugggauuuuggaagcguuggaggcgcauuaaauucccuaggaaaaggaauacaucaaauauucggagcagcauuuaaaucauuauuugguggaaugucuugguuuagucaaauacuaauaggaacauuauuaaugugguuaggauuaaauacuaaaaacggaucaauaagccugaugugcuuagcacuagguggaguacuaaucuuuuugaguacagcagugucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10573 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggcaauaagcggaguaccaguauuaggauuuuuuauaauagcaguuuuaauguccgcucaagagagcugggccguuacuagaagaggaagugcauauuauauguaucucgauagaaaugacgcaggagaagcgauaucauuuccaacaacauuaggaaugaauaaaugcuauauacaaauuauggaucuaggacauaugugugaugcaacaaugaguuacgaauguccaauguuagaugaaggcguagaaccugaugauguagacuguuggugcaacacaacuucaacauggguaguauacggaacgugucaucacaaaaaaggggaagcacgaagaucaagaagggcaguaaccuuaccaucacacucaacuagaaaauuacaaacuagaagucaaacauggcuagaaucaagagaauauacaaaacauuuaauucgaguagaaaacuggauauucagaaauccaggauuugcacuagcagcagcggcaauagcaugguuacuaggaucaucaacuucacaaaagguaaucuaucuaguuaugauacuucucauagcaccagcuuacaguauuagaugcauugguguaucuaaucgagauuuuguugaaggaauguccggaggaacguggguagacauaguuuuggaacauggaggauguguaacggugauggcacaagacaaaccaacaguagauauugaauuagugacaacaacaguuucaaauauggcugaagucagaagcuauuguuaugaagcaaguauaagugauauggccagugauucaagaugcccuacacagggggaagcauaucuugauaaacaaucugauacucaauaugucuguaaaagaacuuuaguugauagaggauggggcaauggauguggcuuauucggaaaaggaaguuuaguaacaugugcuaaauucgcauguucaaaaaaaaugacaggaaaaagcauacaaccugaaaaucuagaauaucguauaauguuaaguguacacggaucacaacacucaggaaugauaguuaaugauacuggacaugaaacagaugaaaacagagcaaaaguagagauuacaccaaauaguccgcgcgcugaagcaacauugggaggauuuggaagccuagguuuagacugugaaccaagaaccggucuagauuuuucagaccuauacuauuugacaaugaauaacaaacauuggcuaguucauaaagaaugguuucaugauauaccacuacccuggcacgcaggagcagauacaggaacaccucauuggaauaauaaagaagccuuaguagaauucaaagaugcacaugccaaaagacaaacaguaguaguauuaggaucacaagaaggagcuguucauacagcacucgcaggcgcauuagaagcugaaauggauggagcuaaaggacgacuaucuucuggacacuuaaaaugucgguuaaaaauggauaaauuacgauuaaaaggaguaucauauagccuauguacugcggcauuuaccuucacaaaaauaccagcagaaacacuacauggaacagucacgguagaaguacaguaugcaggaacagauggaccauguaaaguaccagcucaaauggcaguugacaugcaaacacuaacaccaguaggaagacuaauaacugcaaauccuguaaucaccgaaaguacugaaaacaguaaaaugaugcuugaauuagauccaccguuuggagauagcuauauaguaauaggaguuggagaaaaaaaaauaacccaccauuggcacaggaguggaucaacauuaggaaaagcuuuuucuacaacauugaaaggagcgcaacgucuagcugcauuaggagacacagcuugggauuuuggaucaauaggaggaguauuuaauucaauaggaagagccgugcaccaaguauucggaggagccuuuagaaccuuauucggcggaaugaguuggauaacacaaggacuaaugggagcucuauuacuauggaugggaguuaaugccagagauagauccauugcacuggccuuuuuagcgacaggagggguauuaguauuuuuagcaacaaauguacaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10574 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggcaauaagcggaguaccaguauuaggauucuuuauaauagcaguacuaaugucagcucaagaaaguugggccguaacaagaagaggauccgcauauuauauguaucuagauagaaaugaugcuggugaagcaauaucuuucccuaccacauuaggaaugaauaaauguuauauacaaauuauggaucugggacacacaugugaugcaacgaugucuuacgaguguccaauguuagacgaagguguugaaccagacgauguugauuguuggugcaacaccacaucaacuuggguaguauaugguacaugucaucacaaaaaaggcgaagcgagaagaucaaggagagccguaacauuaccaagucacucaacuaggaaauuacaaacaagaucacaaaccugguuagaaucaagagaauauacaaaacauuuaauaagaguagaaaauuggaucuuucgaaacccaggauuugcuuuagcugcagcagcaauagcuugguuauuaggaucaagcacaucacaaaaaguaauauauuuaguaaugauauuacuaauagcuccagcauacuccaucagauguauuggugucuccaauagagauuucguugaaggaaugagcggaggaacuuggguagauguaguuuuagaacauggcggauguguaacuguaauggcacaagauaaaccaacaguagacauagaguuaguuacaacaaccguauccaauauggcugaaguaagaagcuauugcuaugaagcuucaauaucugauauggcaagugacucaagaugcccaacacaaggugaagcauaucuagacaaacaaucagacacacaauauguauguaaaaggacacuaguagacagaggauggggaaaugguuguggcuuauuugggaaagggaguuuagucacaugcgcaaaauucgcauguucaaaaaaaaugacaggaaaaucaauccaaccagaaaaucuagaauaucguauaaugcuaucuguucauggaucucaacauagcggaaugauuguaaaugacacaggacacgaaaccgaugaaaacagagcaaaaguagaaauaacaccaaauuccccaagagccgaagcaacacuaggagguuuuggaucuuuaggacucgauugugaaccaagaacaggauuggauuucagcgaccuuuauuacuuaacaaugaauaauaaacacugguuaguacauaaagagugguuccaugauauuccauuaccuuggcacgcaggagcugauacaggaacuccacacuggaauaauaaagaagcauuaguagaauucaaagaugcacacgcaaaacgacaaacuguaguaguauugggaucacaagaaggagcagugcauaccgcauuagcuggagcacuagaggcagaaauggauggagcaaaaggccgauuaucaucaggacaucuuaaaugucgucuaaaaauggauaaauugagacuaaaaggcguaucauauucacuuuguaccgcugcuuuuacuuuuaccaaaauaccagccgaaacucuacaugguaccguaacagucgaaguucaauaugcagggacagauggaccauguaaaguuccagcacaaauggcagucgacaugcaaacauuaacgccgguaggaagguugauuacagcaaauccaguaauuacagaaagcacagaaaauucaaaaaugauguuagaauuagauccacccuuuggagauaguuauauaguaauaggaguaggagaaaaaaaaauuacacaccacuggcaccggucaggaucuacucuaggaaaagcuuuuaguacuacauuaaaaggagcacaaagauuagcagcacuaggagauacagccugggauuuuggaucuauagguggaguguuuaacuccauaggaagagcuguacaccaaguuuuuggcggugcuuuuagaacucuuuuuggugguaugucauggauaacacagggacuuaugggggcuuuacuacuguggaugggaguaaacgccagagauagaucuauagcacuagccuuucuagcaacaggaggaguauuagucuucuuagcaacuaauguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10575 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccauaaguggaguaccuguauugggauucuuuauaauagcgguauuaaugucagcacaagaaucaugggcgauaacaagaaggggaagcgccuauuauauguacuuagauagaagcgaugcaggaaaagcaauaaguuuugcaacuacucuaggaguaaauaaaugccauguucaaauaauggauuuaggacacaugugugaugcuacaaugucuuaugaauguccgauguuagacgaaggagucgaaccugacgauguggauugcugguguaacacaacuucaacauggguaguauacggaacuugucaucauaaaaaaggugaagcgcgaagaucccgaagagcaguaacucucccuagucacucaacacgaaaguuacaaacaagaagucaaacuugguuagagaguagagaauauacaaagcacuuaauaaaaguagaaaauuggauuuuuaggaauccagguuuugcgcuuguagcaguagcaaucgcuugguuauuaggaucaucaacaucacaaaaaguaauauacuuaguaaugauauuacucauagcaccagcauacaguauaagauguauugggguaaguaaucgagauuuuguggaaggaaugagugguggaacauggguggauguaguacuugagcacggaggcugcguaacuguaauggcucaagauaaaccaacaguagauaucgaauuaguaacuacuacaguuucaaacauggcugaaguaagaucguauuguuaugaagcgagcauaucagauauggccagugacucaagaugccccacgcaaggagaagcauaucuugauaaacaaagugauacucaauauguauguaaaagaacauuaguagaccgaggauggggaaauggcuguggauuauucgguaaaggaaguuuaguaacaugcgcaaaauuuacauguucaaaaaaaaugacaggaaaaagcauucaaccggaaaaccuagaauaucgaauuauguugucgguucacggaagucagcauagcggaaugauaggauaugaaacagaugaagauagagcaaaaguagaaguaacaccaaauaguccacgugcagaagcaacucucggcggguuuggaagucuaggacuagauugugaaccaagaacaggacuagauuuuagugaucuauacuauuuaacaaugaauaauaaacauugguuaguccauaaagaaugguuucaugauauaccacuuccauggcaugcuggagcagauacaggcacaccacauuggaauaauaaagaagcucuaguagaguuuaaagacgcccaugcaaaaagacagacagugguuguacuagguagccaagaaggagcuguucauacagcauuagcaggagcccuugaagcagaaauggauggagcuaaaggaagauuauuuaguggacauuuaaaaugcagacucaaaauggauaaacuuagacuaaaagguguaucuuacagucuaugcacagccgcauuuacauuuacaaaagucccagcagagacacuacacggaacagugacaguagaaguacaauaugcaggcacugauggaccaugcaaaauacccguacaaauggcaguagauaugcaaacguuaaccccaguaggaagacuaaucacugcaaacccaguaauuacagaaaguacugagaauucaaaaaugaugcuagaauuagauccaccauucggagacaguuacauagugauaggaguaggagauaaaaaaauuacacaucauuggcauagaucagguaguacauuaggaaaagcauuuagcacaacauuaaaaggagcacaaagauuagcagcauuaggcgauacagcaugggauuuugggagcauagguggcguauucaacucuauaggcagggccgugcaucaaguauuugguggagcauucagaacucuauuuggaggcaugucauggauuacacaagguuuaaugggagcauuacuauuauggaugggaguaaaugcaagagauagaaguauagcauuagcguuuuuagcaacaggaggaguuuuaguauucuuagcaacuaauguccacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10576 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggcaauuucaggaguaccaguauuaggauucuuuauuauagccguacuaaugucugcacaagaaagcugggcggugacaagaaggggaagcgcauacuauauguaucuagacagaaaugaugcaggagaagcaauaucuuuuccuacaacauuaggaaugaauaaauguuauauacaaauaauggacuuaggacauaugugugaugcaacgaugagcuaugaaugcccgaugcucgacgaagguguagaaccagaugauguagauuguugguguaauaccacuagcacauggguagucuauggaacgugccaucauaaaaagggcgaagcccgaagaucuagacgagcaguaacguugccaucucauaguacaagaaagcugcaaacaagaagucaaacauggcuagaaucgagagaauauacaaaacacuuaauuagaguagaaaauuggauauuuagaaauccaggauuugcuuuagcagcugcagcaauagccuggcuauuaggaucaucaacaagucaaaaagugauauauuuaguaaugauacucuugauagcaccagccuauucaauaagauguauagguguaucaaacagggauuuuguggaaggaaugaguggaggaacuuggguagacgucgucuuagaacauggaggauguguaacaguuauggcacaagauaaaccaacaguagauauagaauuagucacaacuacuguaucuaauauggcagaaguaaggucauacugcuaugaagcaucaauuagcgauauggcuagugauaguagaugcccaacucaaggagaagcauaucuagacaaacagucagauacacaauauguaugcaaaagaacacuuguagauagaggguggggaaacggauguggacuuuuugggaaaggcagcuuaguaacaugugcaaaauuugcaugcaguaagaaaaugacuggaaaaaguauacagccagaaaaccuagaauacagaauaauguuaaguguacacggaucucaacauaguggaaugauaguaaaugauaccggacacgaaacugaugaaaaucgagcuaaaguagaaauaaccccaaacaguccgagagcagaagcaacuuuaggaggauuuggaaguuuaggacuagacugugaaccaagaacaggacuugacuuuucugaucucuauuacuuaacaaugaauaauaaacacuggcuaguacauaaagaaugguuucaugauauaccacuaccauggcaugccggugcagauacuggcacaccucauuggaauaacaaagaggcuuuaguagaauuuaaagaugcacaugcaaaaagacaaacaguaguagugcuaggaucacaagaaggugcaguacacaccgcacuagccggagcauuagaagcugaaauggauggugcaaaaggaaggcuaucaucaggacauuuaaaauguagguuaaaaauggauaaacuaagauuaaaaggaguaucauauucauuauguacugcagcauucacauuuacaaaaauaccggccgaaacgcuacauggaacuguaacaguugaaguucaauaugcgggaacagauggaccgugcaaaguaccagcacaaauggcaguagauaugcaaacucuaacaccaguuggaagauugauaacagcuaauccaguuauaacagaaaguacagaaaacaguaaaaugaugcuagaauuagauccaccguuuggagauucuuacauuguuauaggaguaggugagaagaaaauuacucaucacuggcauagaaguggcucaacacuaggaaaagcauucagcacuacacuuaaaggagcacaaagauuagcagcucuaggggauacagccugggacuucggcucaaucggaggagucuucaauaguauagggagagcaguacaccaaguauuuggaggagcauuuagaacauuauuuggagguaugagcuggauaacucaagguuuaaugggagcacuucuccuauggaugggugucaacgcaagagaccguaguauagcuuuagcuuuucuagcaacaggaggaguauuaguauucuuagcaacaaacguccaugcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10577 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggauuggacauggauauuauuuuuaguagcagcugcaacaagaguacauaguguaacaaggcgcggaagcgcuuacuauauguaucuggauagaaacgaugcaggagaagcuauaucauuuccuaccacacuuggcaugaauaaauguuauauccaaauaauggaucuuggucauaugugcgacgcaaccaugaguuacgaaugcccaaugcuagaugaagguguagaaccugaugaugucgauuguuggugcaacacgacuucgacuuggguaguauaugguacaugucaucacaaaaaaggagaagcuagaagaaguagaagagcagucacauuaccaucacauucaacaaggaaauuacagacaagaagucaaacauggcuagaaucaagagaauauaccaaacauuuaauaagaguugaaaauuggauauucagaaauccaggauuugcauuagcagcugccgccauagcaugguuauuagggaguucaacaucacaaaaaguaauuuacuuaguuaugauucuuuuaauagcaccugcauauagcauuagauguauuggaguaaguaauagagauuuuguggaaggaaugucugguggaacauggguggauaucguacuggaacauggaggauguguaacuguaauggcgcaagauaaaccaacuguagacauagaauuaguuacaacuacaguaucaaauauggccgaaguuagaaguuauuguuaugaagcaucaauaagugauauggcaucagauaguagguguccaacacaaggagaagcuuauuuggauaaacaauccgacacacaauacguaugcaaaaggacucuaguugauagaggauggggaaauggaugcggauuauucgguaaaggaucauuaguuaccugugcuaaauucgcguguucuaaaaaaaugacagggaaaaguauucaaccagaaaaccuagaauacagaauuaugcuuagugugcauggaagccaacauucaggaaugauugucaacgacacaggucaugaaacagaugaaaaucgagcaaaaguagaaauaacaccuaauucaccacgugcagaagcaacauuaggaggauuuggaucauuaggauuagauugugaaccaaggacaggauuagauuucagcgacuuauacuaucugaccaugaauaauaaacacugguuaguacacaaagaaugguuccaugauauaccauuaccauggcacgcaggagcagacacaggaacaccacacuggaauaauaaagaggcccuuguggaauucaaagaugcacaugcaaaacgacaaacaguaguaguacuuggaucacaagagggagcaguucauacagcauuagcaggagcacuugaggcagaaauggacggugcaaaaggaagauuaaguaguggacauuuaaaauguagacuaaaaauggacaaacuaagauuaaaaggaguuagcuauaguuuauguacagcagcauucacauucacaaaaauuccagcagaaacauuacacggaacagucacaguagaaguacaauaugcaggaacagacggaccauguaaaguuccggcacaaauggcaguagauaugcaaacauuaacaccaguuggacguuuaauaacagcuaauccaguaauaacugaaagcacggaaaauucuaaaaugaugcuagaacucgauccaccuuuuggagauucuuacaucguaauaggagugggggaaaaaaaaauuacucaccacuggcauagaaguggaucaacauuagguaaagcauucaguacaaccuuaaaaggagcacaacgacuagcagcauuaggcgacacagcaugggauuuugguucgauaggaggaguguuuaauucaauaggacgcgcaguucaucaaguuuuuggaggagcauuuagaacauuauuuggaggaaugucauggauaacacagggacuuaugggagcccuauuauuauggaugggagugaaugcuagagauagaucaauagcucuagcauucuuagcaacaggugguguauuaguguuucuagcaacaaauguacacgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10578 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggacuuggauacucuuuuuaguagcugcagcaacaagaguacacucaguaacacgaaggggauccgcauauuauauguauuuagauagaaacgaugcaggcgaagcaauuucauuuccaacaacauuaggcaugaauaaaugcuauauucaaauaauggaccuagggcauacaugcgaugccacuaugagcuaugaauguccaauguuagaugaaggaguggaaccagaugauguagacugcugguguaauacaacaaguacauggguuguauauggcacaugccaucauaaaaaaggggaagcaagaagauccagaagagcuguaacauuaccuagccauaguacaagaaaauuacaaacaagaagccaaacauggcuagaaucaagagaguauacaaaacaccuaauaagaguagaaaauuggauauuuagaaacccagguuucgcauuggcagcagcagcaauugcgugguuacuaggaucaucaacaucacaaaaaguaauauaucuaguaaugauauuauuaauagcaccagcuuauucaauaagauguauaggcguaaguaauagagauuuuguagaaggaaugagcggaggaacauggguggauguaguauuagagcauggaggauguguaaccguaauggcacaagauaaaccaacaguugauauagaguugguuacuacaacuguuucaaauauggcagagguacguucuuacugcuaugaagcaaguaucagcgauauggcaagugacucacguugcccaacucagggggaggccuauuuagacaaacaauccgauacacaauauguuuguaaaagaacacuaguagacagaggauggggaaacggaugugguuuauuuggaaaaggcaguuuagucacuugugcaaaguucgcauguaguaaaaaaaugacagguaaaagcauccaaccagagaaccuagaauacagaauaauguuaaguguucacggaucucaacauagcggaaugauugugaacgauacuggucaugaaacggaugaaaauagagcuaaaguagaaauuacaccaaauagucccagagcagaagcaacccuaggcggauucggaucauugggacuugacugcgaaccuagaaccggacuugauuuuucugacuuguacuacuuaacaaugaauaauaaacacugguuaguucauaaagaaugguuccaugauauaccacugccauggcacgcaggagcagauacugguacaccucauuggaauaauaaagaagcauuaguugaauucaaagacgcacaugcaaaaagacaaacaguaguaguauuaggaagccaagaaggagcaguacacacagcacuagcaggagcuuuggaagcagaaauggacggugcuaaaggaagauugagcaguggacaucuaaaaugucgacuuaaaauggauaaauuaagauuaaaagguguaagcuauucacuauguacugcagcauucacauuuacgaaaauaccagcagaaacucuacacgguacaguuacaguagaaguccaauaugcaggaacagauggaccauguaaaguucccgcacaaauggcaguggacaugcaaacauuaacuccgguuggaagauuaauaacugcaaauccagugauuacggaaucgacagaaaauucaaaaaugaugcuugaauuagacccuccuuuuggagauucauacauaguaaucgguguaggugaaaaaaaaauuacacaucauuggcaucggucagguucaacuuuagggaaagcauuuucgacaacacuaaaaggcgcacaaagauuagcagcacuaggcgacacagcaugggauuucggaaguauaggaggaguuuuuaauagcauaggaagagccguacaucaaguauuuggaggagcuuuucggacucuauuuggaggcaugucauggauaacacaagguuuaaugggggcauuauuauuauggaugggaguuaaugcacgugauagaagcauagcguuagcauuuuuagcaacuggaggaguauuaguauucuuagcaacaaacguacaugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10579 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggacauggauacuauuucuaguagccgcagcgacuagaguacauucaauuacaagaagaggaagcgcauauuauauguauuuagauaggucagaugcugggaaagcaauaucauucgcaacuacuuuggguguaaacaaaugccacguacaaauaauggaucuaggccauaugugugaugcaacaaugucauaugaauguccaauguuagacgaagguguagaaccagaugauguugauugcugguguaacacaaccucaaccugggugguuuaugguacuugucaccacaagaaaggugaagcuagaaggaguaggagggccguaacacuuccaucacauagcacaagaaaacuucaaacuagaucacaaacaugguuagaaucaagggaauacacaaaacaucuaaucaaagucgaaaauuggauauuuagaaacccaggauuugcucuaguugcaguagccauagccuggcucuuaggaucaagcacuucacagaaaguuauauauuuaguuaugauacuauuaauagcacccgcuuauuccauaagauguauaggagugaguaaucgagacuuuguagaaggaaugucaggugguacguggguggauguaguauuagaacauggaggauguguaacaguuauggcacaagacaaaccaacaguagauauagaauuagucacaacaacaguaucaaauauggcagaaguuagaucauauugcuacgaagcgucaauaagugauauggccucagauaguagauguccuacacaaggagaagcguauuuagacaaacaaucagacacacaauauguuuguaaaaggacucuaguugauagaggaugggguaauggauguggauuauucggaaaaggaucccuaguaacaugugccaaauuuacauguaguaagaaaaugaccggaaaaucuauacagccagaaaauuuagaauaucguauaauguuaagcguacaugguagucaacacagcgguaugauaggguaugaaaccgacgaagacagagcaaaaguagaaguaacaccaaacucaccaagagcugaagccaccuuaggaggauucggaagucuuggauuagauugugaaccaagaacuggauuagauuucucagaccuuuauuauuuaacuaugaauaauaaacauugguuaguacauaaagaaugguuucacgacauaccuuuaccauggcaugcaggagcagauacaggaacgccacacuggaacaauaaagaagcauuaguagaauuuaaagaugcucacgcuaaaagacaaacaguuguaguauuagggucacaagaaggugcuguacauacugcauuagcaggagcacuagaagccgaaauggacggagcaaaaggcagauuauuuaguggacaucuuaaaugcagauuaaaaauggauaaacuaagacuaaaaggaguaagcuacagccuauguacugccgcauuuacauuuacaaaaguuccagcugaaacacuacaugggacaguaacaguagaaguccaauacgcaggaacugauggaccauguaaaauaccaguacaaauggcaguagacaugcaaacacuuacaccaguugggagguuaauaacagcuaaucccguaaucacugaaucaacagaaaauaguaaaaugauguuagaacuugacccaccauuuggagauucauacauuguaauuggaguaggugauaagaaaauaacacaucauuggcauagaucuggaucaacacuuggaaaagcauucagcacaacauugaaaggagcacaaagauuagcggcauugggggauacagcaugggauuucggaaguauaggaggaguauuuaauucaauuggucgagcaguccaccaaguauuuggaggagccuuuagaacauuauucggaggaaugucauggauuacacaaggauuaaugggagcccuauugcuuuggaugggaguuaaugcacgagaccguucgauagcucucgcauuucucgcuacuggcggaguucuaguauuuuuagcaacgaauguucaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10580 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggauuggacauggauucuauuucuuguagcagccgcaacaaggguacauagugucacaagaaggggaagugcauauuauauguaucuagacagaaaugaugcuggugaagccauaaguuuuccaacaacgcuaggaaugaauaaauguuacauccaaauaauggaucucggccauaugugugaugcgacaaugaguuaugaaugcccaaugcucgaugaagggguagaaccagaugauguagauuguugguguaauacaacaucaacuuggguaguuuauggaacaugucaucauaaaaaaggugaagcuagaagaucgaggagagcuguaacuuuaccuucucauagcacaagaaaauuacaaacaagaagccaaacuugguuagaaagcagagaauacacaaaacauuuaauuagaguagaaaauuggauauuucgaaauccaggauucgcauuagcugcagcagcaauagcauggcuucuaggcuccaguacaucucaaaaagugaucuauuuaguaaugauacuucuaaucgcaccagcauacaguaucagaugcaucgguguaucaaauagagauuuuguugaaggaaugucgggcggaacauggguagacgucguacucgagcauggcggcuguguaacaguaauggcacaagacaaaccaacaguugauauagaauuaguuacaacuacgguaaguaauauggcagaaguuaggagcuacuguuaugaagcaucaauaucagauauggcaucagauucaaggugcccaacgcaaggagaagcauauuuagauaaacaaagugacacucaauacguauguaaaagaacauuaguugauagaggauggggaaacggaugugguuuauuuggaaaaggaagcuuaguaacaugugcaaaauuugccuguucaaaaaaaaugacaggaaaaaguauacaaccagaaaaucuagaauaccguauaaugcuaucaguacauggaagucaacacagcgggaugauaguaaacgacacaggacacgaaacagaugaaaaucgugcaaaggucgaaauuaccccaaacagcccaagagcagaagcaacucuuggagguuucggaucauuaggacuagauugcgagccaagaaccgguuuagauuuuagcgauuuauacuauuuaacaaugaauaauaaacauugguuaguucauaaagaaugguuucaugauauaccacuaccauggcaugcaggugcggauacuggaacaccucauuggaacaauaaagaagcacuaguagaauucaaagacgcacaugcuaaaagacaaacaguugucguauuaggaagucaagaaggagccguacauacugcacuagcaggugcguuagaagccgagauggauggagcaaaaggccgacuuaguagcggucauuuaaaaugcagauuaaaaauggauaaauugagacugaaaggugugucauauucacuauguacugcagcauuuacauucacaaaaauaccugcagaaacacuacacggaacugucacaguagaaguacaauacgcagguacagaugguccauguaaaguaccagcucaaauggcuguagacaugcaaacauuaacaccaguuggaagacuaauaacagcaaaucccguaauaacugaaagcacagaaaauucaaaaaugauguuggaacuugauccaccauuuggcgauaguuacauaguaauaggaguuggagaaaaaaaaauaacacaucauuggcacagaaguggaagcaccuuaggaaaagcuuuuucaacaacauuaaaaggagcacaaagauuagcagcauuaggugacacagcaugggauuuuggcucaauuggugguguauucaauaguauagggagagcaguacaucaaguuuucggcggagcauuuagaaccuuauuuggcggaaugaguuggaucacucaaggacuaaugggagcacuauuacucuggauggguguaaaugcaagagauagaagcauagccuuagcauuucuugcuacaggaggaguauuaguauuccuagcuaccaauguacaugcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10581 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaaacguagugcaggaucgauaauguggcuagccucauuagcaguaguaauagcaugugccggagcaguaacgaggcgcggaucagcuuauuauauguaccuagacagaaaugaugcaggagaagcaauaucauucccuacaacacuuggaaugaauaaauguuauauacaaauaauggauuuaggacauaugugcgacgcaacuaugaguuacgaaugcccaaugcuugaugaaggcguagaaccagaugauguugauugcuggugcaacacaacgucaaccuggguaguguaugggacaugucaucacaagaaaggagaagcuagaagaaguagacgagcaguaacguuaccgagucauaguacgagaaaauuacaaacacgaucacaaacaugguuagaaagcagagaguacacaaaacauuuaaucagagucgaaaauuggauuuucaggaauccuggguuugcauuagcagcagcggcaauagcaugguuauuaggaucaaguacaucacaaaaaguaaucuaucuaguaaugauucuguuaaucgcucccgcauauuccauuagauguauaggaguaucaaacagagauuuuguggaaggaauguccggaggaacauggguagauauaguuuuggaacauggaggguguguaacagucauggcacaggauaaaccaacgguggauauagagcuaguaacaacaacaguaucaaauauggcagaaguaagaucuuauuguuaugaagcaucuauaagugauauggccagugacaguagauguccaacacaaggggaagcauaucuagacaaacaaagugauacacaauacguauguaaaagaacacuuguagauagaggauggggaaauggaugcggauuauucggaaaaggaucuuuaguaacaugcgcaaaauucgcaugcucaaagaaaaugacagguaaaaguauucaaccagaaaaucucgaauauagaauuauguuaaguguucauggaucacaacacagugguaugauaguaaacgauacagggcaugaaaccgaugaaaacagagcaaaaguagaaauaacaccuaauucaccuagagcagaagcuacucugggaggauucgggagucuuggacuagauugcgaaccaagaacaggucuugauuuuucugaucuauauuaucucacaaugaauaauaaacauugguuaguucacaaagaaugguuucacgacauaccguuaccauggcaugccggagcagauacgggaacuccacauuggaauaauaaagaagcucuuguagaauuuaaagaugcucaugcaaaaaggcaaacaguaguaguuuuaggcagccaagaaggagcaguacacacagcuuuagcuggagcauuagaagcagaaauggauggagcgaaaggaagacuaucgucaggucauuugaaaugcagacuuaaaauggacaaauuaagacuaaaaggaguuucauauucauuauguacugcagcauucacuuuuacaaaaauaccagcagaaacacuacauggcacaguaacuguagaaguacaauaugcuggaacagacggaccaugcaaagucccugcccaaauggcaguggauaugcaaacacuaacaccagugggaagacuaauaacagcaaauccaguaauaacagaaucaacagaaaacucaaaaaugauguuggaauuagauccaccuuuuggagacaguuauauuguaauaggcguaggagaaaagaaaauuacacaccauuggcauagaaguggaagcacacuuggaaaagccuuuagcacaacauuaaaaggagcucaaagauuagcugcacuaggagauacagcgugggauuuuggaaguauaggaggugucuuuaauaguaucggcagagcaguacaucaaguauucggaggagcauucagaacacuauuuggcggcaugucauggauuacacaagguuuaaugggagcucuauuauuauggauggguguaaacgcuagggaucggaguauugccuuagcuuuucuagcaacaggagguguguuaguauuuuuagcaacgaacgugcacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10582 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggaaaacgaucagcaggaucuauaauguggcucgcaucauuagccguaguuauagcaugugcuggagcaguaacaagacgagguagcgcauacuauauguaucuggauagaaaugaugcgggagaagcuauaucguuuccaacaacacuagguaugaauaaauguuauauacaaauaauggauuuaggacauacaugugaugcaacaaugucauaugaauguccaaugcuagacgaaggaguugaaccagacgacguagacugcugguguaauacaacaaguacuuggguagucuauggaacgugccaucauaaaaaaggugaagcaagaaggucccgaagggcaguuaccuuacccagucauucaacuagaaaacuucagacaagaucacaaaccuggcuagaaucacgagaguauacaaaacauuuaauaagagucgaaaacuggauauuuagaaauccuggauucgcacuagccgcagcugcaauagcauggcuccuaggauccuccacaagucaaaaaguaauauauuuaguaaugauccuacucauugcaccagcauauucuauaagguguaucggaguaagcaaucgagacuuuguugagggaaugaguggcgguacauggguagauguuguacuagaacacggcggcugcguaacaguaauggcucaagauaaaccuacaguagauauagaauuaguaacuacuacaguaucuaacauggcagaaguaagaucuuacuguuaugaagccucaauaagcgauauggccucagauucaagauguccaacacaaggagaagcauacuuagauaaacaaucugauacacaauacguaugcaagagaacacuaguagauagaggaugggguaaugguuguggauuauucggaaaaggaagccuaguaacuugugcaaaauuugcauguaguaaaaaaaugacgggaaaaaguauccaaccugaaaauuuagaauauagaauaaugcuaucaguucauggcagucaacauagcggaaugauuguaaaugauacaggucaugaaaccgacgaaaacagagcaaaaguagaaauuaccccaaauaguccuagagcagaagccacuuuaggaggcuuuggaucccuaggucuugauugugaaccaagaacaggauuagauuuuucggacuuauauuaccuuacaaugaauaauaaacacuggcuaguucauaaagaaugguuccaugacauaccuuuaccuuggcaugcaggagcagacacuggcacaccacacuggaacaauaaagaagcgcucguagaauucaaagacgcccaugcaaaaagacaaacuguuguaguauugggaucacaagaaggcgcuguacauacagcauuagcaggagcucuugaagcagaaauggauggagcgaaaggaagacuaucaucggggcacuuaaaaugcagauuaaaaauggauaaguuacguuuaaaagggguuagcuacucucuuugcacagcagcauuuaccuuuacaaaaauaccagccgaaacacuacacgguaccguaacaguagaagugcaauaugcuggaacugaugguccauguaaaguaccugcacagauggcuguagauaugcaaacacuaacgccaguaggaagauuaauaacagcaaauccaguaauaacugaaucaacagaaaacucaaaaaugauguuggaacuagauccaccauuuggagauaguuauauaguaauaggaguaggagaaaaaaaaauaacucaccacuggcauagaucagguaguacguuagguaaagcauuuucgacaacauuaaaaggagcacagagauuagcugcacuuggagauacggcuugggauuucggaucaauaggaggaguauuuaauaguauuggaagagcgguacaucaaguuuuugguggagcauuuagaacccuauuuggaggaaugucuuggauuacacaaggacuuaugggagcauuauuauuauggaugggaguaaacgcucgagacagaucaaucgcauuagcauuuuuagcgacaggaggaguacuaguauuucucgcaacaaacguacacgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10583 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggaaaaagaagugcaggaucaauaaugugguuagcaucacuggcgguaguuauagcaugcgcaggagcuauaacaaggaggggaucagcauacuauauguauuuagacaggagugaugcaggaaaagcaaucucauuugcaaccacacuagguguaaauaaaugucauguccaaauaauggaccuaggucauaugugugaugcuacaaugucguaugaaugcccaaugcuugacgaagguguggaaccagaugacguagauugcuggugcaacacaacaagcacauggguaguuuaugggacaugucaccauaagaaaggugaagcacgaagaucacggcgagcaguaacuuuaccaucacauucaacaaggaaacuacaaacaagaucacaaacaugguuagaaucaagagaguauacaaaacaucuaauuaaagucgaaaauuggauauuuagaaauccuggauuugcccuaguugcaguugcaauagcuuggcuucuuggaagcucaacaucccaaaaaguaauuuauuuaguaaugauacuacugaucgcuccugcauacaguauaagauguauaggaguaaguaauagagacuucguggaaggaauguccggagguacuuggguugauguaguauuagaacacgguggaugcguaacaguaauggcacaagauaaaccuacaguagacauagagcuaguaacaacaacuguaucgaauauggcugaaguuagauccuauuguuaugaagcaaguauaucggauauggcaucagacaguagauguccaacacaaggagaagcauacuuagauaaacaaagcgauacacaauauguauguaaaagaacauugguugauagaggauggggaaauggauguggauuauucggaaaaggaagucuaguaacuugugcaaaauucacguguucaaagaaaaugacaggaaaaucaauacagccggaaaaucuagaauauagaauaaugcuaucaguccauggaagccagcauucaggaaugauaggauacgaaacagaugaagauagagcaaaaguagaaguaacuccaaauucaccaagagcagaagcaacuuuaggcgguuuugguuccuuagguuuagacugcgaaccaagaacaggauuagauuuuucagauuuguacuaccuaacuaugaacaauaaacauuggcuaguucauaaagaaugguuucaugacauuccauuacccuggcaugcuggagcagacacaggaacuccacauuggaauaauaaagaagccuugguagaguuuaaagaugcacacgcaaaaaggcagacuguaguaguauuaggcucucaggaaggggcgguacacacagcauuagcaggagcauuagaagcagaaauggauggagcgaaggguagauuauuuaguggccauuuaaaguguagauuaaaaauggauaaauuaagauuaaaaggaguaucauauagucuuuguacagcagcuuucacauuuacuaaagugccagcagaaacauuacauggaacaguaacaguugaaguacaauaugcuggaacagauggaccauguaagauaccaguccagauggcaguagacaugcaaacucuaacaccagucgggagauuaauuacugcaaacccgguaauaacagaaagcacagaaaacagcaaaaugauguuagaauuagacccaccauuuggugacaguuauauaguaauagguguaggagacaagaaaauuacucaucacuggcaucgaaguggaagcacucuagguaaagcauucucuacaacacuaaaaggagcacaaaggcuagcagcacuaggugacacagcaugggacuuuggauccauaggaggaguuuuuaacucaauagguagagcugugcaucaaguauucggaggagcauuucguacuuuauucggaggaaugaguuggaucacacaaggauuaaugggagcacuauuauuauggaugggagucaaugcaagagauagaucaauagcacuagcauuuuuagcaacuggaggaguguuaguauuucuagcuacuaauguacacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10584 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggaaaaagaucagcaggaaguauaaugugguuagcaagucuagcaguaguaauagcaugcgcaggagcuguaacgcgaaggggaucagcauauuauauguauuuagauagaaaugacgcaggagaagcaauaucauuucccacuacauuaggaaugaacaaauguuauauacaaauaauggacuuaggacauaugugugaugcaacaaugucauacgaauguccaauguuagacgaaggcguagaaccagaugauguagauugcuggugcaauacuacaaguacauggguagucuacggaacaugucaucauaagaaaggagaagccagaagaagcagacgagcaguuacacuaccaucacauaguacgagaaaauuacaaacaagaucacaaaccuggcuagaaaguagagaauauacaaaacauuuaauaagagucgaaaauuggauauuuagaaauccaggauuugcauuagcagcggccgcaauagcauggcuacuugguucuucaacaucacaaaaaguaauauauuuaguaaugauuuuacuaaucgcaccagcauacucaauaagauguauaggcguaagcaacagagauuuuguagaagggaugaguggaggaacuuggguagauguuguauuagaacacggcgguugcgucacaguaauggcacaagacaaaccaacaguagauauagaauugguaacaacaaccguaaguaauauggcagaaguaagaucauauuguuacgaagcaucaauaagugauauggcuucagauucaagauguccuacucaaggagaggcuuacuuagacaaacaaucagacacucaauacgucuguaaaagaacacucgucgauagaggaugggguaauggaugcggacuauuuggaaaaggaucauuaguaacaugugcaaaauucgcaugcaguaagaaaaugacaggaaaaagcauacaaccggaaaaucuugaauacagaauaaugcuuucaguucauggaucacaacauaguggaaugauagucaaugauacaggucaugaaaccgaugaaaauagagcaaagguagaaauaacaccgaacaguccaagagcagaagcaacacucggaggauuuggaucauuagguuuagauugugaaccaagaacgggacuagauuuuagcgauuuauauuaccuaacuaugaauaauaaacauugguuaguacauaaagaaugguuucaugauauaccuuuacccuggcaugcaggagcagauacuggaacuccucauuggaauaauaaagaagcauuaguagaauuuaaagacgcacacgcuaaaaggcaaacaguugugguuuuaggaagucaggaaggagcaguacacacagcauuagcgggagcauuagaagccgaaauggacggagcaaaaggccgauuaucaucaggacaucuuaaauguagacuaaaaauggauaaacuaagauuaaaaggaguuucuuauucauuguguacagcagcauuuaccuuuacaaaaauaccggcugaaacuuugcacggaacggugacaguagaaguacaauaugcagguacagacgguccuuguaaaguaccagcccagauggcaguagacaugcaaacacuaacgccaguagguagauuaaucacagcaaacccaguaauaacggaaagcacagaaaauucuaaaaugauguuagaauuagauccaccuuucggagacucauauauagucauaggagugggugagaaaaagauaacacaccauuggcacagaagcggaaguacauuaggaaaagcauucucaacaacacuaaaaggagcacaacgucuagcugcauugggugauacugcaugggauuuuggcagcauagguggaguauuuaauagcauugguagagcugugcaucaaguuuucggaggagcauuccgaacauuauuuggcggaaugucauggauaacacaaggauuaaugggagcacuauuauuauggaugggaguuaaugcaagagauaggaguaucgcacuagcauucuuagcaacaggaggaguauuaguguuuuuagcaacuaauguacacgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10585 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugacaucaguuggaauaguaggccuacuuuuaacaacagcaauggcagcaguuacauuaccaagucauaguacaagaaaacuacagacaagaagccaaacaugguuagaauccagagaguacacuaaacauuuaaucaggguagaaaauuggauauuuagaaauccaggauuugcacuagcagcagccgcaauagcauggcuauuaggaucuucuacaucacaaaaaguaauuuauuuaguaaugauacuauuaauagcaccugcuuauaguauaagguguauuggaguuucaaaucgagacuuuguugaaggaauguccgguggaacauggguagacauaguauuagaacauggcgguuguguaacuguaauggcgcaagauaaaccaacuguagauauagagcuaguaaccaccacaguaaguaauauggcagaaguuagaaguuauuguuaugaagcgucaauaagugacauggcaagugauagccgauguccaacucaaggcgaagcauauuuagacaaacaaucagauacucaauauguuugcaaaagaacauuaguagauagagguuggggaaauggcuguggauuauuugguaaaggaucauuaguaacuugcgcaaaauuugcauguucaaaaaaaaugacaggaaaaucuauacaaccagaaaaucuagaauacagaauaaugcuaaguguacacggaucccaacauucaggaaugauuguaaaugauacuggacaugaaacagaugaaaauagagcaaaaguagaaauuacaccaaacucaccucgagcagaagcaacauuaggcgguuuuggaucuuuaggauuagauugcgaaccacguacagguuuagauuucucagaucucuauuaucucaccaugaauaauaaacauuggcuaguacauaaagaaugguuucaugauauuccauuaccauggcacgcgggggcagauacaggcacuccacauuggaacaauaaagaagcauuaguagaauuuaaagacgcccaugcuaaaagacaaacaguuguaguacuaggaagccaagaaggagccguacauacagcauuagcuggggcacuagaagcagaaauggauggagcaaaaggaagauuaaguucuggucaucuaaaauguagauuaaaaauggacaaacuacgauuaaaagguguuagcuauagcuuauguacagcagcauuuacauuuacaaaaauaccugcagaaacuuuacauggaacaguaacagucgaaguacaauacgcaggaacagauggcccauguaaaguuccagcacaaauggccguagacaugcagacauuaacacccguaggaagauuaauuacugcaaauccaguaauaacggaauccacagaaaacucaaaaaugauguuagagcuugacccaccguuuggagauaguuauauagugauaggaguaggagaaaaaaaaauaacucaccauuggcacagaagugguucuacaauaggaaaagcauucgaagcaacggucagaggugcaaaaagaauggcuguauuaggagacacagcaugggacuuuggcagcguaggaggagcacuaaacucauuaggaaaaggaauacaccaaauuuucggagcggcauucaaaagucuuuuuggaggaaugucuugguuuucacaaauauuaauaggaacacuacuaaugugguuaggacuaaauacaaaaaauggaucaauaucccugaugugccuagccuuaggaggcguacuaauauuuuuauccacugcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10586 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugacaagcguaggaauaguaggauuauuauuaacaacagcaauggcugcugucacccuaccaagucauaguacaagaaaacuacaaacuagaucacaaacauggcuagaaagucgagaauauaccaaacauuuaauaagaguggaaaauuggaucuuuagaaauccaggauuugcucuggcugcagcggcaauagcaugguuacuuggaucaaguacaucacaaaaaguaauauauuuaguuaugauauuacuuauagcaccagccuauaguauacguuguauaggcguuagcaauagagauuuugucgaaggaaugagcggaggaacauggguagacguaguacuagaacauggaggauguguaaccguaauggcacaagacaaaccuacgguggauauagaauuaguaacgacaacaguaucuaauauggcagagguacgaagcuacuguuaugaagcaaguauaucagauauggcaagugauagcagauguccaacacaaggagaggcauaccuagauaaacaaagugauacacaauaugugugcaaaagaacccuaguagaucgaggcuggggaaauggcugugguuuauuugguaagggaucauuaguaacaugugcaaaauuugcaugcucuaagaaaaugacaggaaaaucaauacaaccugaaaaucuugaauauagaauaauguugaguguacauggaucucaacauagcggaaugauugugaaugacacaggacacgagacagaugaaaauagagcuaaaguagaaauaacaccaaauucaccaagagcagaagcaacauuaggaggauucggaucguuagguuuagauugugaacccagaaccggauuagauuuuagcgauuuauauuaccuaacaaugaacaauaaacauugguuaguacauaaagaaugguuucaugauauucccuuaccuuggcaugcuggagcagauacaggaacaccacacuggaacaauaaagaagcauuaguagaauuuaaagaugcacacgcaaaaagacaaacugugguaguacuaggaagucaagaaggugcaguacacacagcauuagcaggagcauuagaagcagaaauggacggagcuaaaggaagauuaucuucaggacaccuaaaguguagauuaaaaauggacaaacugagacuaaaagguguaaguuauaguuuauguaccgcagcuuuuacauuuacaaaaauaccagcagaaacacuacacggaacaguaacggucgaagugcaauaugcaggaacagauggaccaugcaaagugccagcacaaauggcgguagacaugcaaacauuaacaccaguaggaagauuaauuacugcaaauccaguuauaaccgaaagcacagaaaacucaaaaaugauguuagaacuagauccaccuuuuggagauaguuauauaguaauaggaguaggugaaaagaaaaucacacaccauuggcauagaaguggcucaacaauaggaaaagcauucgaagcaacaguaagaggggcaaaaagaauggcuguacuaggagauacagcaugggauuuuggaucagucggaggagcauuaaacagcuugggaaaaggaauacaucaaauauuuggagcugcauuuaagaguuuauucggcggaaugaguugguuuagucaaauauuaauaggaacuuuacucaugugguuaggguuaaaugccaaaaauggcucgauuagucuaauguguuuagcuuuaggaggaguauuaauauuucuaagcacagcggucucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10587 - RNA, 2158 nt, Artificial Sequence
  ZIKV (strain MR 766) ME variant mRNA Design 2 opt
ggggcgcugccuacggagguggcagccaucuccuucucggcaucaagcuuaccaugacaaguauaggaauaauaggacuacuauuaacaacagccauggcagcaguaacacuaccuucacacucgaccaggaaacuacaaacccgaagucaaaccugguuagaaaguagagaauacacuaaacaucuaauaaaaguugaaaauuggauauuuagaaauccaggauuugcuuugguugcaguugcuauagcauggcuauuaggaagcagcacaucucaaaaaguuauuuaucuaguuaugauacucuuaauagcuccugcauauaguauacgcuguauaggaguaucaaauagagauuuuguagaaggaaugucaggaggcacauggguagauguuguacuagaacacgguggauguguaacaguaauggcacaagauaaaccaacgguagacauagaauuaguaacaacaaccguaaguaauauggcagaaguacgaucauacugcuaugaagcaucaauaagcgacauggcaagugauucuagaugcccaacacaaggugaagcauaucuagauaaacaaucugacacgcaguauguauguaaacgcacgcuaguagauagaggaugggguaacgguuguggucuauuugguaaaggaucucuuguaacaugcgcaaaauucacauguucuaagaaaaugacaggaaaaagcauucagccagaaaaucuagaauacagaauaaugcuaucuguucauggaucucaacauuccgguaugauaggauaugaaacugaugaagauagagcuaaaguagaaguaacaccaaauaguccaagagcugaagcaacacuaggaggcuucgguaguuuaggguuagauugugaaccgagaacaggacuugacuuuagugaccuauauuaucuuacaaugaacaauaaacauugguuaguccauaaagaaugguuccacgauauaccacuaccauggcaugcuggugcagauacaggaacaccacacuggaauaauaaagaagcucuaguagaguucaaagaugcacaugcaaaaagacaaacaguaguaguacuaggaagucaagaaggggcaguacauacagcauuagcaggagcauuagaagcagaaauggacggagcaaaaggacgucucuucuccggacaccuaaaaugcaggcuaaaaauggacaaauuaagguuaaaaggaguaucuuauucacuuuguacagccgcauucacauuuacaaaaguaccagcagaaacacuacauggaacuguaacaguugaaguucaauaugcuggaacagauggaccauguaaaauaccuguacaaauggcaguagauaugcaaacuuuaacaccaguagguagauuaauaacagcaaacccuguuauaacagaaaguacagaaaacagcaaaaugaugcuagaacuagacccuccauucggagacucuuacauaguaauuggaguaggagacaagaaaauaacacaucauuggcaccgaucuggcucaacaauaggaaaagcauuugaagcaacaguaagaggagcaaaaagaauggcaguauuaggagauacugccugggauuuuggaucaguaggaggaguauucaauagcuuaggcaaaggcauacaucaaauauuuggugcugcauucaaaaguuuauuugggggaaugucaugguuuucacaaauucuaauaggaacacuauuaguauggcuaggauuaaacacgaaaaauggaagcauuagucuaacaugucuagcucuagguggaguaaugauauuccuaucaacagcaguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10588 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugacaucaguaggaauagucggauuauuauuaacaacagcaauggccgcaguaacauuaccaagccauaguacuagaaaauuacaaacacgaagccaaacaugguuggaaucaagagaauacacaaaacaucuuauaagaguggaaaauuggauauucagaaauccaggauuugcacuagcagcagcagcuauagcauggcuucuaggcaguaguacaucacaaaaagucauuuauuuaguaaugauauuacuuauagcuccagcauauucuauucguuguauaggaguaucaaacagagacuuuguugaaggaaugaguggaggaacuuggguagauguaguuuuagaacaugguggauguguaacaguaauggcacaagauaaaccuacaguagauauagagcuaguuacaacaacgguaucaaauauggccgaaguaaggaguuauuguuaugaagcaucaauaucagauauggcaucagauaguagauguccaacacagggcgaagccuaucuagauaaacaaucagacacacaauauguauguaaaaggacacugguggauagaggauggggcaacggauguggcuuauuuggaaaagguaguuuagucacaugugcaaaauuugcauguucuaagaaaaugacagguaaaucuauccaaccagaaaaucuagaauauagaauaaugcuuagcguucauggaagucaacacagugguaugauugugaaugauacuggacaugaaacagacgaaaauagagcaaaaguagaaauaacaccaaacucacccagagcugaagcaacacuaggaggauucggaucacuuggacuagauugugaaccuagaacuggacuugauuucagugauuuauacuacuuaacuaugaauaauaaacauugguuaguacauaaagaaugguuccacgacauuccacuaccuuggcaugcuggugcagauacaggaacgccacauuggaauaauaaagaagcacucguagaguucaaagaugcacaugcaaaacgacaaacgguaguuguauuaggaagucaagaaggcgcaguccauacagcauuagcuggagcacuagaagcugaaauggauggagcaaaagguagauuaaguuccggacaccuaaaauguagacuaaaaauggauaaauuaagacugaaagguguaagcuauagucugugcaccgcugcauuuacauucacaaaaauaccugcugaaacauuacauggaacaguaacaguugaaguacaauaugcaggaacagacggaccuugcaaaguacccgcacagauggcuguagacaugcaaacauuaaccccagugggaagacuaauaacagcaaauccaguaauaacagaaagcacugaaaauucaaaaaugauguuagaacucgauccaccauuuggggauagcuauauaguaauaggaguaggcgaaaagaaaauaacacaccacuggcauagaagugguaguaccauuggaaaagcauuugaagcuacagucagaggagcaaaaagaauggcaguacuuggcgauacagcuugggauuuugguucuguaggcggagcuuuaaacaguuuaggaaaaggaauacaucaaaucuuuggagcagccuuuaaaaguuuauuuggaggaaugaguugguuuucccaaauuuuaauaggaaccuuauuaauguggcuagguuuaaauacgaaaaaugggagcaucagcuuaaugugucuagcacuuggugggguauuaauauuucuaagcacagcgguaucugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10589 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccauaagcggaguaccaguauuaggauucuucauaaucgcaguacuaaugagugcacaagaaaguugggcagcagugacauuaccaagucacaguacaagaaaauuacaaacacguagucaaacaugguuagaaagucgagaauauacaaaacaucuaauacguguagaaaacuggauauuuagaaauccaggauuugcuuuggcagcagcugccauagcauggcuucuaggaagcucaacaucacaaaaaguuauauaucuagucaugauucuucuaaucgccccugcauauucaauaagauguauaggagucucaaacagagauuucguagaaggaaugucaggaggaacauggguagacauaguccuugaacacggaggauguguaacuguuauggcccaagauaaaccuacuguagauauagaauuggucacaacuacaguaagcaacauggcagaaguaagaucauauuguuaugaagcuagcauaucagauauggcaucagauucaagaugcccaacacaaggugaagcauaucuagauaaacaaucagauacacaauacguauguaaacgaacauuaguagauagaggauggggaaauggauguggacuuuuuggaaaaggaucauuaguaacaugcgccaaauuugcguguucaaagaaaaugacuggaaaaucaauacaaccggaaaaccuagaauauagaauaauguuaaguguucauggaucacaacauucagguaugauaguuaaugauacaggacaugaaacagaugaaaacagagcaaaaguagaaauaacaccaaauucaccaagagcagaagcaacauuaggcgguuucggaaguuuaggacuugauugugaaccuagaacagguuuagauuuuucagaccuauauuauuugacaaugaauaacaaacacugguuaguacacaaagaaugguuccaugauauaccacuaccauggcaugcuggugcggauacaggaacuccccauuggaauaauaaagaagcguuaguagaauuuaaagacgcacacgcaaaaagacaaacuguaguaguauugggaucucaagaaggagcaguacacacugcauuagcaggagcacuagaagcagaaauggauggagcuaaaggcagacuuagcaguggacauuuaaaaugucguuuaaaaauggacaaauuaagauuaaaagggguauccuacucccuaugcacagcugcuuuuacuuucacaaaaauuccugcagaaacacuucauggaaccguaacaguagaaguacaauacgcgggaacagaugggcccugcaaaguacccgcacaaauggcaguagauaugcaaacauuaacaccuguaggcagauugauaacugcuaauccaguaauaacagaaucaacagaaaauaguaaaaugaugcuagaauuagacccaccauuuggcgauaguuauauagucauuggaguuggggagaagaaaauaacucaucacuggcacagaucaggaaguacuauaggaaaagcauucgaagcaacagugagaggagcaaaaagaauggcaguauuaggugauacagcuugggauuuuggaucaguaggaggagcacuaaacucucuagguaaaggaauccaucaaauuuuuggugcagccuuuaaaucauuauuuggaggaaugucaugguucagucaaauauuaauagguacauuauuaauguggcugggacuaaauacuaaaaacgguaguauaagccuaaugugucuagcacucggugguguacuaauauucuuaaguacagcagucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10590 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggcgauaaguggaguaccaguguuaggauuuuuuauaauagcaguacuaaugucugcucaagaaucaugggcagcagucacauuaccaucacacucaacuaggaaauuacagacccgaucgcaaaccuggcuggaaucaagagaauauacaaaacacuuaauaagaguagaaaauuggauauuuagaaaucccggauucgcacuagcagcggcugcaauugcuugguuacuuggauccaguacaucccaaaaaguaauauauuuaguaaugauacuucuuaucgcaccagccuauaguauuagauguauuggaguaucaaauagagauuuuguagaaggaaugucaggagguacuuggguugaugugguacuagaacacggcggaugugucacaguaauggcacaagauaaacccacaguagauauagaauuaguaacgacaacagugucaaauauggcagaaguaagaucauauugcuacgaagcaaguauaagugacauggcaucagauucacgauguccaacacaaggagaagcauauuuagauaaacaaucagacacacaauauguauguaaaagaacauuagucgauagggguuggggaaacggaugcggcuuauuuggaaaaggauccuuaguaaccugugcaaaauucgcauguucgaaaaagaugacaggaaaaucuauacaaccagaaaauuuagaauauagaauaaugcuaucaguacacggaucucaacauucagguaugauaguaaaugauacuggacaugaaacagacgagaacagagcaaaaguagaaauaacuccaaauagcccacgugcggaggccacacuaggaggauuuggaagccuggggcuagacugugaaccuagaacaggacuagauuucucagaccuauauuauuuaacaaugaauaacaaacauugguuaguccacaaagaaugguuucaugauaucccacuaccauggcacgcaggugcagauacggguacaccacauuggaauaacaaagaagcauuagucgaauuuaaagaugcccaugcaaaaagacaaacaguaguaguacuagguucacaagaaggagcugugcauacagcacuagcuggugcauuagaagcagaaauggauggagcaaaaggaagauuaucaagcggacauuugaaaugucgacuaaaaauggauaaacuuaggcuuaaagguguaagcuacucuuuauguaccgcagcauucacguucacaaaaauaccagccgaaacauuacacgguacuguaacaguagaaguacaauacgcagguacagauggaccauguaaaguaccagcucaaauggcaguagacaugcaaacuuuaacaccaguagggagauuaauaacagcgaauccaguaauuacagaauccacagaaaacaguaaaaugaugcuagaauuagauccacccuuuggagacucauauaucguaauagguguaggugaaaaaaaaauaacacaucacuggcaucgaucuggaucaaccauaggaaaagcauuugaagcuacaguaagaggagcgaaaaggauggcaguuuuaggagacacugcaugggauuuugguaguguaggaggagcauuaaauucauuggguaaaggcauacaucaaauauucggagcagcauuuaaaagcuuauuuggaggaaugaguugguuuucacaaauacuaauaggaacuuuacuuaugugguuaggucuaaaugcuaaaaauggcucaauaucacuaauguguuuagcacuagguggaguacuaauauuuuuaaguacagcuguaucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10591 - RNA, 2185 nt, Artificial Sequence
  ZIKV (strain MR 766) ME variant mRNA Design 2 opt
ggggcgcugccuacggagguggcagccaucuccuucucggcaucaagcuuaccauggcaauaucagguguaccagucuuagguuucuuuauaauagcaguauuaaugucagcacaagaaagcugggccgcaguaacucuacccagucacucgacaaggaaacuacaaaccagaucacaaacaugguuagaaaguagagaauauacaaaacaccuuauuaaaguagaaaauuggauauuuagaaauccuggguucgcguuagucgcaguagcaauagcauggcuauuaggaagcagcacaagucaaaaaguaauauaccuaguaaugauauuacuaaucgcgccagcauauaguauacguuguauaggaguuucaaacagagacuuuguagaaggaaugucaggagguacauggguagaugucguauuagaacauggaggaugugucacaguuauggcucaagauaaaccaacaguagauaucgaauuaguaacaacuacugucaguaauauggccgagguuagaucauacuguuacgaagcaucaauaucagauauggcaagugauaguagaugcccaacacaaggagaagcauauuuagacaaacaaucagauacucaauacguauguaaacgaacacuaguagacagagguuggggaaacggauguggauuauuuggaaaaggaaguuuaguaacaugugcaaaauuuacuugcucaaaaaaaaugacuggaaaaucaauucaaccggaaaaucuagaauaucgaauaaugcuaaguguacauggaagccaacauucaggaaugauuggcuaugaaacugaugaagacagagcuaaaguugaagugacaccaaacucaccuagagcagaagcaacauuaggagguuucgguucauuaggauuagauugcgaaccacgaacagguuuagauuucagugaucuauauuauuuaacaaugaacaauaaacauuggcuaguacauaaagaaugguuccaugauauaccacucccauggcaugcgggugcagacacaggcacuccacacuggaacaauaaagaagcuuuaguagaauuuaaagaugcacacgcaaaaagacagacaguaguuguacuaggaucacaagaaggagcaguacacaccgcacuugcaggcgcauuagaagcggaaauggacggagccaaagguagauuauuuaguggacauuuaaaauguagauuaaaaauggauaaauuaagacuaaaaggaguaagcuacucauuaugcacagcagccuuuacauuuacaaaaguacccgcugaaacauugcacggaacaguuacaguugaaguucaauacgcaggaacagauggaccauguaaaauaccaguacaaauggcagucgacaugcaaacauuaacaccaguaggucgacuaauaacagcaaaccccguuauaaccgaaucuacugaaaacucgaaaaugaugcuagaacuagacccaccguuuggagauucauauauaguaauaggcguaggagauaaaaaaauaacacaucauuggcacagauccggaagcacaauaggaaaagcauuugaagcuacaguaagaggagcuaaaagaauggcaguauuaggagauacagcaugggacuuuggaaguguaggagguguauuuaacaguuuaggaaaaggaauacaucaaauauuuggcgcagccuuuaaaagccuauucggaggaaugagcugguuuucacaaauucuaaucggaacucuacuaguguggcuaggacuuaauacaaaaaaugguagcauaaguuuaacaugucuagcauuaggagguguuaugauauuucuaucaacagcgguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10592 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggcaauuucuggaguuccaguauuagguuuuuuuauuauagcgguacuaaugagugcacaagaaagcugggcagcaguaacauuaccuagucauaguacuagaaaacuacaaacaagaucacaaacaugguuagaaucgcgagaauauaccaaacauuuaauaagaguagagaacuggauuuucagaaauccaggcuucgcccuagcagcagcagcaauagcaugguuauuaggaaguucaacaucacaaaaaguuauauaucuagucaugauauuauugauagcgcccgcauauucaauacgauguaucggaguaucaaauagagauuuuguagaaggaaugucuggaggaacuuggguagacgucguacuagaacacgggggauguguaacaguaauggcucaagauaaaccuacaguagauauagaauuaguaacgacaacaguaagcaacauggcagaagucagauccuauuguuaugaagccaguauuagcgacauggcgagcgauagcagauguccaacacaaggggaagcuuauuuagauaaacaaucagacacacaauacguauguaaaagaacauuaguagauagagguuggggaaaugguuguggacuuuuuggaaaaggaaguuuaguaacaugugcaaaauuugcaugcucuaaaaaaaugacaggcaaaucaauacaaccagagaaccucgaauauagaauaauguuaagcguacauggaagucaacauagcgguaugauaguaaaugacaccggacacgaaacagacgaaaauagagcaaaaguagaaauaacgccaaauaguccgcgcgcagaagcaacauuaggaggauucggaucacuaggauuagacugugaaccaagaacaggacuugauuuuucugaucuauacuaucuuacaaugaauaauaaacauugguuaguucauaaagaaugguuccaugauauuccuuuaccauggcacgcaggugcagauacaggaacaccacauuggaauaauaaagaagcauuaguagaauucaaagaugcucaugcuaaacgucaaacuguaguuguauuaggaagccaagaaggagcaguucauacugcauuagcaggagcauuagaagcugaaauggauggugcaaaagguagauugaguaguggacauuuaaaauguagacuaaaaauggacaaauuacgacuaaaaggaguuucauauagucuauguacugcugcauuuacauucacaaaaauaccagcugaaacauuacacggaaccguuacaguugaaguacaauacgcaggcacagauggaccaugcaaaguuccagcacaaauggcaguagacaugcaaacauuaacaccaguaggaagacuaauuacagcaaauccuguaauaacagaaucaacugaaaauagcaaaaugauguuagaauuagauccaccauuuggagauucauauauugugauaggaguaggagaaaaaaaaauuacacaccacuggcauagaucugggucaacaauagguaaagcauucgaagcuacuguaagaggagcaaaaagaauggcaguacuuggagauaccgccugggauuucgguaguguaggaggagcacuaaacucacuuggaaaaggcauacaucaaauauuuggagcagcauuuaaaucacuauuugguggaaugucaugguuuucacagaucuuaauagguacacuacuaauguggcuaggacuuaauacaaaaaauggaucaauaucauuaauguguuuagcauuaggaggaguuuuaauuuuuuuaagcacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10593 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggauuggacauggauauuauucuuaguugcagcugcaacaagaguacauagugcaguaacauugccgucacacucaacaaggaaauuacaaacaagaagccaaacaugguuagaaagccgagaauacacaaaacauuuaauuagaguagaaaacuggauauuuagaaauccaggauuugcucuagcggcagcagcaauagcaugguuacuuggaucaucaacaagccagaaaguaauauacuuaguaaugauacuucuuauagcuccagcauacucaauacgauguauuggaguaagcaauagagauuuugucgaaggaaugucaggaggaacaugggucgacaucguauuagaacaugguggauguguuacaguaauggcacaagauaaaccuacuguagauauagaacucguaacuacaacuguaucaaacauggcagaaguaagaucauacugcuaugaagcaucaauaagugauauggcaucggauaguagauguccuacacaaggagaagcauauuuagauaaacaaucagauacacaauacguauguaaacguacuuuaguagauagagguuggggaaauggaugcggauuauuuggaaaagguaguuuaguaacaugugcaaaauuugcuuguucaaagaaaaugacagguaaaaguauacaaccagaaaauuuggaauauagaauaauguuaucuguacauggaagccaacauaguggaaugauuguaaaugauacaggacaugagaccgaugaaaauagagcaaaaguagaaauaacuccaaauucaccacgagcagaagcgacauuaggaggauucgguucauuagguuuagauugugaaccaagaacagggcuagauuuuucugaucuauauuaucuaacuaugaacaauaaacauuggcuaguacauaaagagugguuucaugacauaccauuaccauggcaugcuggagcagauacaggaacaccacauuggaacaauaaagaggcuuugguugaauuuaaagacgcccacgcaaaaagacagacaguagucguuuuaggcagucaagaaggagcaguucacacagcauuagcuggagcauuagaagccgaaauggacggagcaaaaggucgauuaucaaguggacaccuaaaauguagauuaaaaauggacaaacuacgacuuaaagggguuucauauucacuauguacagcagccuuuaccuuuacaaaaauaccagcagaaacuuuacaugguacaguaacagucgaaguccaauaugcagguacagauggcccauguaaagucccggcacaaauggcaguagauaugcagacacuaaccccaguaggaagacuuauaacagcaaauccaguuauaacagaaucuacugaaaauucaaaaaugauguuagaguuagauccuccauuuggagauagcuauaucguaauaggagucggagaaaagaaaauaacacaucauuggcauagaaguggaaguaccauaggaaaagcauuugaagcaacaguaagaggagccaaaagaauggcaguacuuggagauacggcaugggauuuuggcagcguaggaggugcauugaauaguuuaggaaaaggaauacaucaaaucuuuggugccgcauucaaauccuuauuuggaggaaugagcugguuuucacaaauacuaaucggaacauuacuaaugugguuaggauuaaauacuaaaaauggaagcauaaguuuaaugugccuggcacuaggaggaguacuaauauuuuuaaguacagcagugagcgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10594 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggauuggacauggauauuauucuuaguagcugcagcaacccgaguacacucagcagucacauuacccagucauagcacaaggaaauuacaaaccagaucacaaacuugguuagaaucaagagaauacacaaaacaucucauaagaguugaaaacuggauauuuagaaaccccggcuuugcucuagcagcagcagcaauugcauggcuacuaggaagcucuacaucacaaaagguaauauauuuaguaaugauacuauuaauagcaccagcuuacaguauuagauguauaggaguuucgaauagagacuuuguagaaggaaugucaggagguacauggguagauguaguacuagaacauggcggaugugugacaguuauggcacaagauaaaccaaccguagauauagaauuagugacgacaacaguaucaaauauggccgaaguaagaucuuauuguuaugaagcauccauuucugacauggccucagauaguagaugccccacucaaggagaagcauacuuagauaaacagucagacacucaauacguuuguaaaagaacucuaguagauagagguugggguaauggauguggauuauuuggaaaaggaagccuaguaacaugcgcaaaauuugcauguaguaaaaagaugacuggaaaaucaauacaaccagaaaaccuugaauaucgaauuauguugucaguccacggaagucaacauaguggaaugauaguaaaugacacaggacacgaaacagacgaaaauagagcuaaaguagaaauaacaccaaauucuccgagagcugaagcaacacuuggaggauuugguagcuuagguuuagacugugaaccaaggacuggauuggacuuuucagaucuauauuauuuaacaaugaauaauaaacacuggcuaguacacaaagaaugguuucacgauauuccauuaccauggcaugcaggagcugacacagguacaccacauuggaauaauaaagaagcauuaguagaguucaaagaugcacacgcgaaaagacaaacaguaguagugcuagguucacaagaaggagcaguacauaccgcauuagcaggagcauuagaagcagaaauggauggagcaaaagggagacuaucaaguggacauuuaaaauguagauugaagauggauaaauuaagauugaaagggguaucuuacaguuuauguacugcagcuuucacauuuacaaaaauaccagcagaaacacuacauggaacaguaacaguugaaguacaauacgcaggaacagauggacccugcaaaguuccagcucaaauggcaguagauaugcaaacucuaacgccaguaggacgguuaauaacagccaauccagugauuacagaaucgacagaaaacucaaaaaugaugcucgaauuagauccacccuuuggagauucauauauuguuauaggaguaggagaaaagaaaauaacacaucauuggcauaggagcggcucaacuauaggaaaagcauucgaagcaacaguaagaggagcuaaacgaauggcaguauuaggagauacagcuugggacuucggaagcguuggaggagcccuaaauaguuuaggaaaaggaauacaucaaauauucggagcagcauuuaaaucauuauuuggaggaaugaguugguucucacaaauucuuauuggaacccuauuaauguggcuaggcuugaaugcuaaaaauggaaguauaagucucaugugcuuagcacuaggagggguauuaauauuuuuauccaccgcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10595 - RNA, 2164 nt, Artificial Sequence
  ZIKV (strain MR 766) ME variant mRNA Design 2 opt
ggggcgcugccuacggagguggcagccaucuccuucucggcaucaagcuuaccauggauuggacauggauauuauuuuuagucgcagcagcaacuagaguacauucugcaguuacuuuaccaagucauucaacaaggaaacuacaaacaagaucacaaacauggcuagaaucaagagaauacacuaaacaucuaauaaaaguagaaaauuggauauuuagaaaucccggcuuugcacucguggcaguagcaauagcaugguuguuagggagcucuaccagucaaaaaguuauuuaucuuguaaugauacuacuaauagcaccagcauauagcauaagauguauaggaguuagcaacagagacuuuguggaaggaaugucaggaggaacauggguagaugucguacuagaacauggcggauguguaacaguaauggcacaagauaaaccaacaguagauauagaacuaguaacaacaacuguaucuaauauggcagaaguaagaucauacuguuaugaagcaagcauuucugauauggcaucagauagcagaugcccaacacaaggagaagcauaucuagauaaacaaagugauacacaauacguaugcaaaagaacauuaguugacagaggaugggggaaugguugcggucuguuuggaaaaggaaguuuaguuacaugugcuaaauuuacaugcaguaaaaaaaugacuggaaaaagcauucaaccagaaaauuuagaauaccgaauaauguuaagcguacauggaagccaacacucaggaaugauaggauaugaaacagaugaagauagagcuaaaguagaagucacaccgaauucaccaagagcugaagcaacucuaggagguuuugguucacuugguuuagauugugaaccaagaacaggacuagacuucucagauuuguauuaccuaacaaugaauaauaaacauuggcuaguucauaaagaaugguuucacgacauaccauugccuuggcacgcaggagccgauacuggaacaccacauuggaauaauaaagaagcacucguagaauuuaaagaugcacaugccaaaagacaaacuguagucguacuaggaagucaagaaggggccguacauacugcauuagcaggcgcacuagaagcugaaauggauggcgcaaaagguagacuauucagcggacaccuaaaaugucgauuaaaaauggauaaauuaagauuaaagggaguaagcuauucuuuauguacagccgcuuuuacauucacuaaaguaccagcagaaacauuacacgguacaguaaccguagaaguccaauacgcaggaacagauggaccaugcaaaauuccaguacaaauggcaguagauaugcaaacguuaacaccaguaggucgauuaauuacagcaaauccaguaaucacagaaucaacagaaaauucgaaaaugaugcucgaacuagacccuccauucggagauaguuauauaguaaucggaguaggagauaaaaaaauaacacaccacuggcauagaaguggcucaacaauagggaaagcauuugaagcaacaguaagaggagcaaaaagaauggcaguuuuaggugacacugcaugggacuuugguaguguaggagguguauuuaauagcuuaggaaaaggaauccaucaaauauuuggagcagcauucaaaucauuauucggugguaugucaugguucucacaaauucuaauagguacacuucuuguuugguuaggucuaaauacaaaaaauggaucaauuucucuaacauguuuagcuuuaggaggggucaugaucuucuuaucuacggcaguaucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10596 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggacauggauucuauuucucguagcagcagcaacaagaguucauucagcaguaacauuaccaucacauucaacaagaaaacuacaaacaagaagucaaacauggcuagaaucgagagaauauacaaagcauuuaaucagaguagaaaacuggauauuuagaaacccuggauuugcauuggccgcugcugcaauagcaugguuacuuggaagcagcacaagucaaaaaguaauauaucuaguaaugauacuauuaauagccccagcauauucaauuagauguauaggagucucaaauagggauuucguagaaggaaugaguggaggaacauggguagacguaguacuagaacacggugggugcguaacaguaauggcacaagacaaacccacaguagauauagaauuagugacaacuacaguuaguaacauggcagaaguuagaaguuauuguuacgaagcaagcauaagugauauggcaagcgauucucgauguccgacucagggagaagcauaucuagacaaacaaucugauacacaauauguguguaaacgaacucuagucgauagaggguggggaaauggauguggacucuuuggaaaaggaagucuaguaacgugcgcuaaauuugccuguaguaagaaaaugacgggaaaauccauacaacccgaaaacuuagaauauagaauaauguuaagugugcauggaagucaacauaguggaaugauaguaaacgauacaggacacgaaacagaugaaaauagagcaaaaguagaaauaacacccaauagccccagagcagaagcaacacuaggagguuuuggaucauuaggacucgauugugaaccuagaacuggguuagauuuuucagauuuauauuauuuaacaaugaauaauaaacauugguuaguucauaaagaaugguuucaugauauaccuuuaccauggcaugcuggggcagacacaggaacaccacauuggaauaacaaagaagcauuaguagaauuuaaagacgcacaugcuaaaagacaaacugugguagugcuagggagucaagaaggggcaguacauacagcauuagccggagcuuuagaagcagaaauggauggagcaaaaggaagauuauccagcggacaucuaaaauguagauuaaaaauggauaaauuacguuuaaaaggugugagcuacucacuuuguacagcugcauuuacauucacaaaaauuccagcagaaacccuacacggaacagucacagucgaaguacaauacgcaggaacagacggaccuugcaaaguacccgcucaaauggcagucgauaugcaaacauuaacaccuguagguagacuaauuacagcaaauccaguaauaacagaaucaacagaaaauaguaaaaugaugcucgaauuagauccaccauuuggugauucauauauaguuauaggaguaggagagaaaaagauuacacaucauuggcauagaaguggaaguacaauaggaaaagcauuugaagcaacaguaagaggagcaaaacgaauggcaguauuaggagauacagcuugggacuuuggaaguguuggaggugcacuaaauaguuuaggaaaaggaauacaucaaauauuuggagcagcauuuaaaucauuauuuggugguaugucgugguuuucccaaaucuuaauaggaacuuuauuaauguggcuaggauuaaauacgaaaaauggaucaauaucacucaugugucuagcauuaggaggaguuuuaaucuuuuuaucaaccgcaguuucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10597 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccaugggaaaaagguccgcaggaaguauaaugugguuagcuagcuuagcaguagugauagcaugugcaggagcugcaguaacauuaccaucacauuccacaagaaaacuacaaacaagaucucaaacaugguuagaaucaagagaauacacaaaacaccuaauacgaguagaaaacuggauauuuagaaauccuggauucgcacuagccgcagcagcaauugccugguuauuaggaaguaguacaagccaaaaaguaauauauuuaguaaugauauuauuaauugcaccagcauauaguauaagauguauaggaguaaguaauagagauuuuguagaaggaaugaguggagguacauggguagauauaguauuagaacacggaggauguguaacaguuauggcucaagauaaaccuacaguugauauugaauuaguaaccacuacaguaucaaauauggcugaaguaagaaguuauuguuaugaagcaaguauuagcgauauggcgagugauagcagaugucccacacaaggugaagcauacuuagauaaacaaagugacacacaauauguaugcaaaagaacucuaguagauagaggauggggaaacgguugcggauuauuuggcaaagguagcuuagucacaugugcaaaauuugccugcaguaagaaaaugacaggaaaaaguauacaaccagaaaauuuagaauauagaauaaugcuuagcgugcacggaucacaacauucaggaaugauagugaaugauacaggacaugaaacagacgaaaauagggcaaaaguugaaauuacgccaaauagucccagggcagaagcaaccuugggaggauuuggcaguuuaggacuagauugugaaccaagaaccggauuagauuucucugaucuauauuauuuaacgaugaauaauaaacacugguuaguacacaaagaaugguuucaugauauaccauuaccguggcacgcaggagcagauacaggaacaccucauuggaauaauaaagaagcucuaguagaauuuaaagacgcccacgcgaaaagacaaacagucguaguauuagguagccaggaaggagccguucacacagcauuagccggugcuuuagaagcagaaauggauggagcaaaagguagacuaagcaguggacacuuaaaauguagguuaaaaauggacaaauuaagacuaaaagguguaucauauaguuuauguacagcggcauuuacguucacaaaaauucccgcagaaacauuacacggaacaguaacaguagaaguacaauaugcaggaaccgauggaccauguaaaguaccagcacaaauggcaguagauaugcaaacauuaacaccuguaggaagacuuaucacagcaaauccuguuauaacagaaagcacagaaaauucaaaaaugauguuagaauuagacccaccauucggugauaguuacauaguaauaggaguaggcgagaagaaaauuacacaucauuggcauagaucaggauccacaauagguaaagcguucgaagcaacagugagaggagcaaaaagaauggcaguauuaggggauacugccugggauuuuggaucaguagggggagcauuaaauagucuaggaaaagguauacaccaaauuuuuggagcggcuuuuaaaucucuauuuggugggaugucaugguuuucacaaauacuaauaggcacacuacucauguggcuaggauuaaacacgaaaaauggaagcauaucauuaaugugucuagcacuaggagguguccuaauauuccugucaacagcaguaagugcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10598 - RNA, 2194 nt, Artificial Sequence
  ZIKV (isolate Z1106033) ME variant mRNA Design 2 opt
ggggcgcugccuacggagguggcagccaucuccuucucggcaucaagcuuaccaugggaaaaaggagcgcaggaucaaucaugugguuagcaucauuagcaguaguaauugccugcgcuggugcagcaguaacauugccaagucauucuacaagaaaacuacagacaagaagccaaacauggcuagaaucuagagaauacacaaaacauuuaauaagaguugaaaacuggauauuuagaaauccaggauuugcacuagcagcagcagcaauagccugguuauuaggaaguucaacaagucaaaaaguaauuuacuuaguaaugauacuauuaauagcuccagcauauaguauaagauguauaggaguaucaaauagagauuuuguugaagguaugaguggaggaacauggguagauguuguacuagaacauggaggauguguaacuguaauggcacaagauaaaccaacagucgacauugaacuaguaacaacuacagugucuaacauggcugaaguaagaucauauugcuaugaagcaucuauaagugauauggcaucagauagcagauguccuacucaaggagaagcauaucuugauaaacaaucagauacacaauauguauguaaaagaacauuaguagauagaggauggggaaaugguuguggcuuauuuggaaaaggaagucuaguaacaugugcaaaauuugcaugcaguaaaaaaaugacgggaaaaaguauacagccagaaaaccuagaauacagaauuauguuaagcguucaugguagucaacauaguggaaugauaguaaacgauacugggcaugaaacugacgagaauagagccaaaguagaaauaacaccaaauucaccgagagcagaagcuacacuugguggauucggaucacuuggucuagauugcgaaccaagaacaggacuugacuucucagaccuauauuaucuaacaaugaauaauaaacauugguuaguucauaaagaaugguuucaugauauaccauuaccauggcaugcaggagcagauacgggaacaccacauuggaauaauaaagaagcacuagucgaauuuaaagaugcacaugcaaaaagacaaacgguaguuguacuaggaucacaagaaggagcaguacauacagcauuagcuggggcuuuggaagcagaaauggauggcgcgaaaggaagacuaucaaguggacauuuaaaaugccgauugaaaauggauaaauuaagauuaaaaggaguaaguuacucauuauguaccgcugcguuuacauuuacgaaaauuccagcagaaacguuacauggaacaguaacagucgaaguucaauaugcaggaacagacggaccauguaaagugccagcacaaauggcaguagacaugcaaacauuaacaccagugggaagauuaauaacagcaaacccaguaauaacagaaucuacggaaaauagcaaaaugauguuagaacuagacccacccuucggagauucauauauuguaauaggaguuggagaaaaaaaaauuacgcaucacuggcauagaagugguaguacaauuggaaaagcauuugaagcuacaguaaggggagcaaaaagaauggcaguacuaggagauacugcaugggauuucgguaguguuggaggugcacuaaauagccuuggaaaaggaauucaucagauauuuggagcagcauuuaaaucauuauuuggaggcaugaguugguucagucaaauauuaauuggaacucuauuaaugugguuagguuuaaacgcaaagaauggaucaauaaguuuaauguguuuagcacuaggaggaguauuaauauuccuuucaacagccguuucggcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10599 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggaaaaagaucagcaggaaguauaaugugguuagcaucacuagcaguaguaauagcaugugcuggagcagcaguaacauuaccaucacauucaacaagaaaauuacagacaagaagccaaaccugguuagaaucaagagaauacacaaaacauuuaauaaaagucgaaaacuggauauuuagaaauccaggauucgcucuaguagcaguagcaauagcuugguuacuaggaucaagcacaucacaaaaagugaucuaucuaguuaugauacuauuaauagccccugcauauucuauaaggugcauaggaguaagcaacagagauuuugucgaaggaaugucaggaggaacauggguagauguugucuuagaacauggagguugcguuacaguaauggcacaagauaaaccaaccguggauauugagcuaguaacgacaacaguaaguaacauggcagaaguaagaaguuauuguuacgaagcaaguauaucagacauggcaucagauucaagauguccgacucaaggagaagcauaucuagauaagcaaucagauacacaauacguuugcaaaagaacauuaguagauagaggauggggaaauggaugcggauuauuuggaaaaggaaguuuaguaacaugcgcaaaauuuacuuguaguaagaaaaugacaggaaaaaguauucaaccugaaaaucucgaauauagaaucaugcuaaguguucauggaagccaacauucuggcaugauaggauaugaaacagaugaagauagggcaaaaguagaaguuacaccuaauucaccaagagcagaagcaacauuaggagguuuuggaaguuugggacuagacugugaaccucgaacugguuuagacuuuagugauuuauacuauuuaacgaugaauaauaaacauuggcuuguacauaaagaaugguuucaugacauaccauuaccauggcacgcaggagcagauacaggaacaccacacuggaauaauaaagaagcauuaguagaguuuaaagaugcucaugcaaaacgacaaacagugguaguauuaggaucucaagaaggagcuguacauacagcucuggcgggugcauuggaagcagaaauggauggagcaaaaggacgacuguucagcggacauuuaaaaugcaggcuuaaaauggauaaauuaagauuaaaaggaguaucauauucacuauguacagcugcuuuuacauucacaaaagucccagcagagacucuacauggaacaguaacuguugaaguacaauaugccggaacagauggaccauguaaaauuccuguacaaauggcaguagauaugcaaacacuuacuccaguaggaagauuaauaacggcaaaccccguuauaaccgaaucaacagaaaauaguaaaaugaugcuagaacuagauccuccauuuggugauucauauauaguaauaggaguaggagacaagaaaauaacacaccauuggcauagaaguggaaguacuauaggaaaagcauuugaagcaacagugagaggagccaaaagaauggcuguacuaggagauacagcaugggauuucgguucaguaggcggaguuuuuaacucauuaggaaaagggauacaucaaauauuuggagcagccuucaaaucacuguucggcggaaugagcugguuuucucaaauauugauugggacccuauugguauggcucggacuaaauacuaaaaaugguagcauaucauuaacaugccuagccuuaggaggaguaaugauuuuccuuagcacagcaguuagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10600 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggcaaaagaucagcaggaagcaucaugugguuagcuaguuuagcagucguaauagccugugcaggagcagcaguaacauuaccgagccacucaacaaggaaauugcaaacccggagccaaacauggcuagaaaguagagaauauacaaaacaucuaaucagagucgaaaacuggauauucagaaauccuggauuugcauuagcagcagcagcaauagcauggcuauuaggaucaaguacaagucaaaaaguaauauaucuaguuaugauauuacuaauagcaccagccuacucaauaagauguauaggaguaagcaauagagacuuugucgaaggaaugagcggaggaacuuggguagauguaguauuagaacacggagguugcguaacggucauggcacaagacaaaccaacaguagacauugaauuaguaacaacgacaguuucaaauauggcagaaguccgaaguuacuguuaugaagcgucaauaucugacauggcaagugacucuagauguccuacucaaggagaggcuuauuuagauaaacaaagugauacacaauauguauguaaacgaacguuaguggauagaggaugggguaaugguugcggucuguucgguaaaggaucucuaguaacaugugcaaaauuugcuuguuccaagaaaaugacaggaaaaucaauacaaccagaaaauuuagaauaucgaauaauguuaaguguacauggaagucaacauaguggaaugauuguaaaugauacaggacaugaaacagaugaaaauagagcaaaaguggaaauaacuccaaauucaccaagagcagaagcuacauuaggaggcuuugguagcuuaggauuagacugcgaaccaaggacgggucuagacuuuagugaccuuuauuaucuaacaaugaauaauaaacauugguuaguacauaaagaaugguuccaugauauuccauuaccauggcacgcaggagcagauacuggaacaccacauuggaacaauaaagaagcauugguugaauuuaaagaugcacaugccaaaagacaaacaguaguaguacuuggaucccaagaaggagcaguacauacagcauuagccggugcauuagaagcagaaauggacggagcaaaagguagacuuagcagcggacaucuuaaauguagacuaaaaauggauaaauuaagauuaaaaggaguaucuuauagucuaugcacagcagcauucacuuuuacuaaaauacccgcagaaacguuacauggaacaguaacaguagaaguacaauaugcaggaacagauggcccauguaaaguaccagcacaaauggcaguugauaugcagacauuaacaccuguaggaagacuaauaacagcaaauccaguaauaacagaaucaacagaaaauaguaaaaugauguuggaauuagauccaccauucggagauucuuacauaguaauaggaguaggagaaaagaaaauaacccaucauuggcauagaucaggaaguacaauuggaaaagcauuugaagcaacaguaagaggagcaaaacgaauggcaguacuuggagacacagcaugggauuuugguucgguaggaggagcauuaaauucacuagguaaaggaauacaucaaauauuuggagcagcguuuaaaucacucuucgguggaaugucaugguucagucaaauucuaauaggaacauuauuaauguggcucggucuaaauacgaaaaauggaucaauuucacucauguguuuagccuuagguggaguccucauauucuuaucaacagcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10601 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccauaagcggcguacccguccucggauucuucauaaucgcaguccucaugagcgcccaagaaaguugggccgucacccgcagaggaagugcauacuacauguaccucgaccgcaacgacgcgggagaagccaucuccuucccaaccacccuaggcaugaacaaaugcuacauccaaaucauggaccuaggacauaugugcgacgccacaaugagcuacgaaugccccaugcucgacgaagguguagaacccgacgacguagacugcuggugcaacacaacaucaaccuggguaguauacggaacaugccaucacaaaaagggagaagccagacgcagccgcagagccguaacacuacccucacacucgacacgaaaacuucaaacacggucacagaccuggcuagaaucccgugaauacaccaaacaccuuauaagaguagagaacuggaucuuccgaaaccccggguucgcccucgccgccgccgccaucgcauggcuacucggcuccagcacaucacaaaaaguuauauaccuaguuaugauccuccugauagccccugccuauagcauaagauguauaggcguaucaaaccgcgacuucguagaaggcaugucaggcggaacauggguggacauaguccuagaacacggcggcugcgucaccguaauggcccaagacaaaccaaccguagacauagaacuuguaaccaccacggugucaaacauggccgaaguacggagcuacugcuacgaagccucaauuuccgacauggcgagcgacuccaggugcccgacacagggagaagcauaccucgacaagcaaucagacacccaguacgucugcaagagaacacucguagacagaggcuggggaaacgguugcggacuguucggcaaaggcagccuggucacaugcgcgaaauucgccuguagcaaaaagaugaccggaaagucgauccaacccgaaaaccuagaauacaggaucaugcugagcguccauggcagccaacacagcggcaugaucguaaacgacaccggacacgaaaccgacgaaaaccgggcuaaaguagaaaucaccccaaacucccccagagccgaagccacgcuagggggauucggcucacuugggcucgacugcgaacccagaaccggacuagauuucagcgaucuauacuacuuaaccaugaacaacaaacacuggcucguacacaaagagugguuccacgacauaccccugccauggcacgccggcgccgacaccggcacaccacacuggaacaacaaagaagcgcuuguagaguucaaggacgcacacgcuaaacgccaaaccguaguagugcuggggagccaagaaggcgcgguacacacggcccucgccggggcacuagaagcagaaauggacggagccaaggggcggcugucaagcggccaccugaaaugccgccucaaaauggacaaacuuaggcuuaaaggagucuccuauagccuaugcacggccgccuucaccuucacaaaaauaccagccgaaacccuccacggcacuguaacagucgagguccaauacgccggcacagacggacccuguaaaguaccagcgcagauggccguagacaugcaaacgcuuacacccguaggacgccuaaucacagcaaacccaguaaucaccgaguccacagaaaacagcaaaaugaugcuugaacucgaucccccauucggggacuccuacauagucaucggcgucggcgaaaagaaaauaacccaccacuggcaccgcuccggcucaacgauaggaaaggcauucgaagcaacaguaagaggagcaaaaagaauggcaguccucggggacacagccugggacuucggaucgguaggcggcgcccucaacagccucggaaagggcauacaccaaaucuucggagcagccuucaaaucacuauucggaggcaugagcugguucagucaaauccugaucggcacccuccucauguggcucggccucaacacgaaaaacggauccaucucccucaugugccuagcacucggcggaguccucauauuccuuuccaccgcggugagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10602 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggcaauaucgggaguacccguacugggauucuucauaauagcaguccucauguccgcacaagaauccugggcagucacaagacgcggauccgccuacuacauguaccuagaccgaaacgacgccggcgaagccaucucauucccaacaacacuaggaaugaacaaaugcuacauccaaaucauggaccucggacauacgugcgacgcaacaaugagcuacgaaugccccaugcuggacgaaggaguagaaccagacgacgucgacugcuggugcaacacaaccagcacuuggguaguauacggcacaugccaccacaagaaaggcgaagccagacgaagcagaagggcaguaacccuaccuucgcacucgacccgaaaacugcagacaagaagccagacauggcuggaaucacgcgaauacacaaaacaccucauacgagucgagaacuggaucuucaggaaccccggauuugcccuggcggccgccgcaaucgcauggcuccucggcagcucaacgucacaaaaaguaauauaccuggucaugauccuacucaucgcacccgccuacagcaucagaugcauaggagucagcaaccgggacuucguagaaggcaugagcggcggcaccuggguagaugugguucuagaacacggcgguugcgucacagugauggcacaagacaaacccaccguagauauagagcuagucaccaccaccgucagcaauauggccgaaguccggagcuacugcuacgaagccagcaucagcgacauggcauccgacagccgcugcccaacccaaggagaggcauaccuagacaaacaaagugacacacaauacgucugcaaacgaacacucguagacagaggcuggggcaacggauguggccucuucgguaaaggcucacucgucacaugcgcaaaauucgcaugcagcaagaaaaugaccggcaaaagcauccaaccagaaaaccuugaguauagaaucaugcuaucgguacacggaucccaacauucaggcaugaucguaaacgacacgggccaugaaacagacgaaaaucgagccaaaguagaaauaaccccgaacagcccgagggcagaggcaacacucgguggauuuggcagccugggccucgacugcgaaccccgaaccggucuugacuucuccgaccuguacuaccuaacaaugaacaacaaacacuggcucgugcauaaagagugguuccacgacaucccacugcccuggcacgccggcgcagacaccgguacgccacacuggaacaacaaagaagcacucgucgaguucaaagacgcacacgcaaaacgccaaacgguaguaguccucggcucacaagaaggagccgugcacaccgcccuagccggcgcacucgaagcagaaauggacggcgcaaaaggccgacucuccucaggccaccucaaaugccgccuaaaaauggacaaacugcgccucaaaggagucagcuacuccuuaugcacagcagccuucaccuucacaaaaauaccugcagaaacccuucacggcaccgucaccgucgaaguacaauacgcagguaccgacggccccugcaaaguaccagcccaaauggccguagacaugcaaacccugacccccgugggcagacuuauaaccgccaaccccguaauaacagaaagcaccgaaaacucaaaaaugaugcucgaacucgaucccccguucggcgacagcuauauagucaucggagucggcgaaaagaaaaucacacaucacuggcacagaucaggaagcaccaucggaaaagccuucgaggcgacaguacgcggagccaaacggauggccguccucggagacaccgccugggacuucggaucaguaggaggggcacuuaacucccuaggaaaaggcauccaccaaaucuucggcgcagccuucaaaucacuauucggggguauguccugguucucccaaauccuaaucggaacucuccucauguggcucggacucaacgcgaaaaacggcaguaucagccucaugugccucgcacuaggaggagugcuaauauuccuaucaacagcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10603 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucucaggcgucccagugcucggauuuuucaucauagcaguauuaaugagcgcgcaagaaaguugggcaauaaccagacgcggcuccgccuacuacauguaccuggaccgcuccgacgcaggcaaagccaucagcuucgcaaccacccucggaguaaauaagugccacgugcaaauaauggaccuaggccacaugugcgacgccacaaugucauacgaaugcccgaugcucgacgaaggaguagaacccgacgacguggacugcuggugcaacacaacguccacauggguaguauacggaaccugccaccacaagaaaggagaggcaaggcgaagccgcagagcaguaacccuacccagccacaguacacgaaaacuacaaacgcggagccaaacuuggcuggaaucacgcgaauacacaaaacaccuaauaaaaguggaaaacuggauauuccggaaccccggauucgcacugguggcaguagcgauagccuggcugcucggcagcucaaccucccaaaaagucaucuaccucguaaugauacuccugauagcaccagcguacuccauaaggugcauaggcgucagcaaccgugauuucgucgagggaaugucaggaggaaccuggguagacguaguccuagaacacgggggcugcgugaccgucauggcccaggacaagccuacagucgacauagaacucgucacaaccacgguaagcaauauggcagaaguaagaagcuacuguuacgaagcaucaaucagcgacauggccagcgacucaagaugcccaacccaaggagaagccuaccuagacaaacagagcgacacccaauacgucugcaagcggacgcucguagacagaggcuggggaaauggaugcggccucuucggaaagggaagccuagugaccugcgccaaauucacaugcagcaagaaaaugacaggaaaauccauccaacccgagaaccucgaauaccgcauaauguuaagcguccacgggucacaacauagcgguaugaucggcuacgaaaccgacgaagacagggcaaaaguagaaguaacccccaacagcccaagagcugaagccacacucggaggauucggcagccuaggacuagacugcgaaccacgcacuggacuugacuucuccgaccuauacuaccucacgaugaacaacaagcacuggcuaguccacaaagaaugguuccacgacauaccccuaccuuggcacgccggcgcggacaccggaacaccacacuggaacaacaaagaggcacucgucgaguucaaggaugcacaugccaaacgccaaacagucguaguacugggaagccaggaaggagccguacacacagcccucgcaggagcacucgaagcugaaauggacggcgcaaaaggccggcuuuucagcggccaccucaaaugccggcuaaaaauggacaaacuccggcugaaagggguaagcuacagccucugcaccgcagcguuuacguucaccaaaguacccgcagaaacacuacacggcacaguaacagucgaggugcaauacgcaggcaccgacggccccugcaagauaccaguacaaauggcagucgacaugcaaacacugacaccugucgggcgacuaauaaccgcaaacccagucaucaccgaaagcaccgagaacagcaaaaugaugcucgagcuagacccaccauucggcgacagcuacaucgucauaggcgugggcgacaagaaaaucacacaccacuggcacagguccggcagcaccaucggcaaagccuucgaagcgacaguacgcggagcaaaacgaauggcagucuugggcgacacagccugggacuucggcagcgucggcggagucuucaacucacuagggaaaggaauacaccagauauucggagccgccuucaagagccuauucggaggaaugagcugguuuagccagauacucauaggcacccuacucgucuggcuaggucuaaacacaaagaacggcuccaucucauuaacaugccuggcauugggcggagugaugauauuucucagcacagccguaagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10604 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggccauauccggcguaccaguccucggguucuucauuauagcaguccucaugagcgcacaagaaucgugggccguaaccagacgaggaucugcauauuacauguaccuagaccggaacgacgcgggagaagccaucucauuucccacaacacucggaaugaauaaaugcuacauccaaaucauggaccucggccacaugugcgacgcaacgaugagcuacgaaugccccaugcuagacgagggggucgaacccgacgacgucgacugcuggugcaacacaacaucaaccuggguaguauacggcacaugccaccacaaaaagggcgaagcccgacgauccaggcgagcaguaacauuacccucccauuccacccgcaaacuccaaacgcgcucgcaaaccuggcuagaaucacgagaauacacaaaacaccucauccgaguagaaaacuggaucuucagaaauccgggauucgcccuggccgcugccgccaucgccuggcuacucggcuccagcaccucacagaaagucaucuaccucguuaugauacuccucauagcgccagccuacucuauccgcugcaucggaguaagcaaccgagauuucguagaaggcaugucaggcggcacaugggucgacgucguccuagaacacggaggcugcguaacagucauggcccaagacaaaccgaccgucgacaucgagcuaguaaccacaaccgucuccaauauggccgaaguccgaagcuacugcuacgaagcgucaaucuccgacauggcaagcgacucccgaugcccaacccaaggcgaagccuaccuagacaaacaguccgacacccaauacguuugcaaacgcacacucgucgaccgaggauggggcaacggcugcggccucuucgggaaaggaagccucguaaccugcgcaaaauucgcaugcagcaagaaaaugaccggaaaauccauccaacccgaaaaccuggaauaccgcauaaugcucucaguacacggaucccagcacagcggaaugauagugaacgauacaggacacgaaacugacgaaaaccgagcaaaaguagaaaucacccccaacucaccacgagcagaagccacccuaggcggauucggcucauuaggccucgacugcgaaccuaggacgggccucgacuucuccgaccuauacuaccugacaaugaacaacaaacacuggcuaguacacaaagaaugguuucacgauaucccccuacccuggcacgccggcgccgacacaggcacaccgcacuggaacaacaaggaagccuuaguagaguucaaagacgcccacgccaagcgccaaaccgucgugguccugggaucccaagaaggcgccguacacaccgcccuagcaggcgcccuugaggccgaaauggacggggcaaaaggccgccuaucauccggacaucucaagugccggcucaaaauggacaaacuacgacuaaaaggcguaagcuacucccucugcacagccgcuuucacauucaccaaaauaccagcggaaacucuccacggcaccgucaccgucgaagugcaauacgccggaacagacggaccaugcaaagugcccgcccaaauggccgucgacaugcagacucuaaccccaguagggcgacucauaaccgcaaaucccgucaucaccgaaagcaccgagaacagcaaaaugaugcucgaacuggacccucccuucggcgacagcuacaucgucaucggaguaggcgaaaagaaaaucacccaccacuggcaccgaucgggaagcaccaucggcaaagccuucgaagcgacagucagaggcgcaaaacgcauggccguccucggagacaccgcaugggacuucggcagcgucggaggcgcacucaacucucugggcaaagggauccaccaaauauucggcgccgccuucaaaucccucuucgggggaaugucgugguucucacagauacuuauaggaacacuacucauguggcucggacuaaacaccaaaaacggcuccauaucccucaugugccuagcccuaggaggaguccuaaucuuccucucgacagcggucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10605 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggacauggauacucuuccuaguagccgccgccacccgcguacacucagugacgcgccgcggcucagcauacuacauguaccucgaccggaacgacgccggagaggcgauaucauuccccaccacacuaggaaugaacaaaugcuacauacagaucauggaccucggccacaugugcgacgccacaauguccuacgagugcccaaugcuggacgaagggguagaaccagacgacgucgacugcuggugcaacaccacguccacauggguggucuacggcacaugccaccacaagaaaggagaagcgcgccgaucacgcagagccgucacccucccaagccacuccacaagaaaacuccaaaccagaagccaaacuuggcucgaaucccgggaauacaccaagcaccucauacgcguagagaacuggauauuccgcaacccaggcuucgcgcuagcagccgccgccauagccuggcuacuaggcucauccacaucacaaaaagugaucuaucuaguaaugauacuacuaauagcacccgccuacagcaucagaugcauaggcgucucaaacagagacuucguagaaggcaugucaggaggaaccuggguagauaucguacucgaacacggcggauguguaaccgucauggcccaagacaaacccacuguagauaucgagcuaguaacaacaacaguauccaacauggccgaaguaagauccuacugcuacgaagcaucaaucucagacauggccucagacucgaggugcccuacucagggagaagccuaccuagacaaacaaagcgacacgcaauacgucugcaaaagaacccuagucgauagaggcuggggaaacgggugcgggcuauucggcaagggaucacucguaaccugcgcaaaguucgcaugcuccaagaaaaugaccgguaaaagcauccaacccgaaaaccucgaauacagaaucaugcuaucgguacacggaucccagcacuccggaaugauuguuaacgacacgggucacgaaacagacgaaaaccgggccaaggucgaaauaacaccaaacagcccacgagcagaagccacccuaggaggcuucggcucccucggccucgacugcgaaccccguaccggcuuggacuucagcgaccuauacuaccucaccaugaacaacaaacacuggcugguccacaaagaaugguuccacgacauuccccuccccuggcacgcaggggccgacacaggaaccccacacuggaacaacaaagaggcccuuguagaguucaaagacgcacacgcaaaacgccaaacagucgucguccucggcucgcaagaaggagccguacacacagcacuagccggcgcacuagaagcagaaauggacggcgcaaaaggccgccuaagcucaggccaccucaagugccggcucaagauggacaaacuacgccuaaaaggagucucauacucccuaugcaccgcggccuucaccuucaccaaaaucccggcagagacccuacacggaaccguaaccguugaaguucaauaugccggaaccgacggacccugcaaaguacccgcccagauggcagucgacaugcaaacacuuaccccaguuggccgccucaucacggcaaaucccgucaucaccgaaaguacagaaaacucaaaaaugaugcuagaacuagacccgcccuuuggcgacucauacauagucauagggguaggagagaaaaagauaacccaccacuggcaccgcagcggguccacgauagguaaagccuucgaagcaaccguaagaggcgcgaaacgaauggcaguacuaggugacaccgcaugggacuucgggagcgucggcggggcacuaaauucacuugggaagggaauccaccaaaucuucggggccgcauucaagagucucuucggcggcaugagcugguucucacaaauccucauaggaacccuccuaauguggcuaggccucaacaccaaaaacggaagcauaucccuaaugugccuagcacucggaggcguacucaucuuccucagcacagcgguaagcgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10606 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggacguggauacuauuccucguagccgccgcaacccgcguccacagcguaacccgaagaggcuccgcuuacuacauguaccucgaccgaaacgacgccggcgaagccauaucauuccccaccacccucggcaugaacaaaugcuacauccaaauuauggaccuagggcacacuugcgacgccacaaugagcuacgagugccccaugcucgacgaaggcgucgaaccagacgacguggacugcuggugcaacaccaccagcacauggguaguauacggaaccugccaccacaagaaaggcgaagcccgaagaucacgccgggccguuacccuccccucacacuccacacgaaagcuccaaacccgcucccaaaccuggcucgaaucucgagaauacacaaagcaccuuauaagaguugagaacuggaucuucagaaaccccggcuucgcccuagccgcagccgcaaucgccuggcuccucggcuccucaacaucccaaaaagucauauaccuugucaugauccuccucauagcaccagccuacucgauccgaugcaucggcguuuccaaccgcgacuuugucgaaggcaugaguggaggcaccugggucgacguaguacuagaacacggaggcugcgucacaguaauggcacaagacaaaccgacaguagacaucgagcuaguuacaacaaccguaucuaauauggccgaaguccgcucauacugcuacgaagccuccaucuccgacauggcauccgacuccagaugcccuacccaaggcgaagccuaccucgacaaacaauccgacacccaauacgucugcaaacgcacccucguagaccgaggguggggcaacgguugcggccuguucggaaagggaucccuagucacaugcgcaaaguuugccugcuccaagaaaaugacgggaaaaucaauacaacccgaaaaccuagaauaccgcauaaugcucagcguccacgggucacaacacagcgguaugauagugaacgacacuggacacgaaacagacgagaacagagcgaaagucgaaaucacaccgaacuccccucgcgcagaagccacgcuaggaggguucggaucacuuggacucgacugcgaaccccgcaccggccucgacuucagcgacuuauacuaccuaacaaugaacaacaaacauuggcuaguccacaaagaaugguuccacgacauaccccuacccuggcacgccggcgcagacacaggaacaccccacuggaacaauaaagaagcccucgucgaguucaaagacgcccacgcgaaaagacaaaccgucguuguacugggcagccaagaaggcgccguccacaccgcacuagcgggggcucuagaagcagaaauggauggcgccaaggggcgacuaucaucaggccaccucaaaugcagacuaaaaauggacaaacuccgccucaaaggaguaucauacucacuaugcaccgccgcguucacauucaccaaaauacccgcugaaacucuccacggaacagucaccgucgaaguccaauacgcaggaaccgacggccccugcaagguaccagcccaaauggccguagacaugcaaacacuaacccccgucggaagacuaaucaccgcgaaccccguaauaacagaauccacagagaacucaaaaaugaugcucgaacuagacccaccguucggagacucuuacauagucauaggagucggagagaaaaagaucacacaccacuggcaccgcucaggcucaacaauuggcaaagccuucgaagccacgguacggggagccaaaagaauggccguacuaggggacacagccugggacuucggaucagucggcggugcacuaaauucacuaggaaaaggcauccaccagaucuucggcgcagccuucaaaagccuauuugguggaaugucaugguucagccaaauccucauagggacccuccucauguggcucggccucaacgcuaaaaacggaagcaucucgcuaaugugccuagcccucgggggcguccuaauauuccucagcacggcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10607 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggacuggaccuggauacuguucuuaguagccgccgccacgcgaguccacagcauaacacgcaggggaucagcauacuacauguaccucgaccgauccgacgccggaaaagcaauaucauucgcaaccacgcuaggagucaacaaaugccacgugcaaaucauggaccuaggucacaugugcgacgccaccauguccuacgagugcccuaugcucgacgaaggaguagaaccagaugacgucgacugcugguguaacacaaccuccacaugggucgucuacggcacaugccaccacaagaaaggagaagccagacgaagccgucgcgccgucacacuaccaagccacagcacaagaaaacuccaaacccggucacaaacauggcuugaaagccgagaauauacaaaacaccucauaaaaguagaaaacuggaucuuccggaacccaggguucgcgcucguagccguggcaauagccuggcuccucggauccagcacaucccaaaaagucaucuaccuaguaaugauccucuugauagcacccgccuacucaauacgaugcauaggagucagcaaccgcgauuucguagaaggaauguccggcggaacaugggucgacgucguccucgaacacgguggaugcgucaccgucauggcacaagacaaacccacagucgacauagagcuagucaccacaacuguaagcaacauggccgaaguacgcuccuacugcuaugaagcauccauauccgacauggcaucggacagccgcugcccaacgcaaggcgaagccuaccuagacaaacaaucagauacccaguacgucugcaaaaggacccuaguagaccgaggauggggcaacggaugcggacucuucggaaaaggcagccuaguaaccugcgcaaaauucacaugcuccaagaaaaugacaggaaaaagcauacaaccggaaaaccuagaguacaggaucaugcuaagcgugcacggcucccaacacucaggaaugauaggcuacgaaaccgacgaagaccgagcaaaagucgaaguaacacccaacucaccccgggcagaagcaacccuagggggauucggaucccuaggacucgacugcgaaccccgcacaggacuggacuucuccgaccuauacuaccuaacgaugaacaacaaacacugguuaguccacaaagagugguuccacgauaucccccuaccauggcacgccggagccgacacaggaacgccacacuggaacaacaaagaagcccuagucgaguucaaagacgcacacgccaaaaggcagacagucguagugcuaggcucgcaagaaggggcaguccacaccgcacucgccggagcacuagaagccgaaauggacggagccaaggggcggcuauucucaggccaccugaaauguagacuuaagauggauaaacugcgacuaaaaggagugagcuacucccucugcacagccgcauucacguucacaaaaguaccggccgaaacacugcacgggacagucaccguugaaguccaauacgcagggacugacggccccugcaaaauccccguccaaauggccgucgacaugcaaacccuaacccccguaggacgacuaaucacggcaaacccuguaauaacagaaucaacagaaaacagcaaaaugaugcuugaacuagacccaccauucggagacuccuacaucguaaucggaguaggugacaagaagauaacacaccacuggcacagaagcggcuccacaaucgggaaagcguucgaagccacaguccgcggcgccaaaagaauggcuguacuaggagacaccgcaugggacuucggcuccguaggcggagucuucaacucgcuagggaaaggaauacaccaaauauucggagcagccuucaaaucccuauucggaggaauguccugguucucgcaaauccuaaucggcacacuccuggucuggcuaggacuaaacacgaaaaauggaagcauuucccuaacaugccucgcccucggaggaguaaugauauuccucagcaccgccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10608 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggaccuggauacuauuccucguagccgccgcaacacgaguccacagcguaaccaggcgcggaucagccuacuacauguaccuggaccgaaacgaugccggcgaggcgauaucauuccccacaacccucggcaugaacaaaugcuacauccagaucauggaccucgggcauaugugcgacgccaccauguccuaugaaugcccgaugcucgaugaaggagucgaaccagacgacgucgacugcuggugcaacaccaccagcaccugggucguauacggaaccugccaccacaagaaaggcgaagcccgccgaagcagacgcgcagucacacuaccaagccacucaacacgaaaacuacaaacccgaucacaaaccuggcucgaaucccgagaauacacaaaacaccuaauccgagucgaaaacuggauauuccgaaacccaggauucgcccucgcggccgccgccauagccuggcuacugggauccagcacaagccaaaaagucaucuaccuugucaugauccuacuaaucgccccagccuacuccauacgaugcaucggagucagcaacagagacuucgucgaaggcaugucaggaggaacauggguagacguaguacucgaacacggcggcugcguaaccguaauggcccaagacaaacccacaguagacauagaacuuguaaccaccacagucuccaacauggcagaaguccgcucauacugcuacgaagcauccaucagcgacauggcaagcgacucacgcugcccaacccaaggcgaagcauaccuggacaaacaaagcgacacgcaauacgucugcaaaagaacacucguggaccgcggauggggcaauggaugcggccucuucggcaaggggagccuagugaccugcgcaaaauucgccuguucaaagaaaaugaccggcaaaagcauacaaccugagaaccucgaauaccgcauuaugcugagcguccacgggagccaacacagcggcaugaucguaaacgacaccggucacgaaaccgacgaaaaccgcgccaaagucgagaucaccccaaacucaccccgcgccgaggcuacacugggaggauucggcucacuagggcuugacugcgaaccgagaacaggcuuagacuuuucagaccuuuacuacuuaaccaugaacaacaaacacuggcucguccacaaagaaugguuucacgacaucccccugccauggcacgccggcgcugacaccgguacaccacacuggaacaacaaagaggcccuaguagaguucaaagacgcccacgcaaaacgccaaaccguagucguacuaggcucccaagaaggagcaguacacaccgcccuggccggagcacuagaagcagagauggacggagccaaggggcgccucagcuccgggcaccucaaaugucgccugaaaauggacaagcuaaggcuaaagggcguauccuacucccuaugcacagccgccuucaccuucaccaaaaucccagcagaaacccuccacggaacggugacuguggaaguccaauacgcaggaaccgauggacccugcaaaguacccgcacagauggcgguggacaugcaaacccuaacgcccgucggacgccucauaaccgccaacccagucauaacagaaucaacagaaaacagcaaaaugaugcucgagcucgacccacccuucggagacagcuacaucgucaucgggguaggcgaaaagaaaauaacccaccacuggcacagaucaggaucuacaaucggaaaagccuucgaagccaccguccgcggugcgaaacgaauggccguccuaggcgacaccgccugggacuucggcagcgucgggggcgcacucaacucccuaggaaaaggcauccaccaaaucuucggcgccgccuucaaaagccucuucggaggcaugucaugguucagccagauccucauaggcacacuccuaauguggcuaggccucaacaccaaaaacgggucaauuagccuaaugugccucgcacugggaggcgugcuaaucuuccuaagcaccgcagucucggcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10609 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggaaaaagaagcgcaggaucaauaauguggcuagcuucccuggccguaguaaucgccugcgcaggcgcaguaacacgucgaggguccgcauacuacauguaccucgauaggaacgacgcaggagaggcaaucucuuuccccaccacacuaggcaugaacaaaugcuacauccaaaucauggaccuaggacacaugugcgacgccacuauguccuacgaaugccccaugcuagacgaaggaguagaaccggacgacguugacugcuggugcaacaccacaucaaccugggucgucuacggaacaugccaccacaagaaaggagaagccagacgaagcagacgagccguuacacuaccaucccacagcacaagaaaacuacaaaccagaucacagaccuggcuagaaagcagagaauacaccaaacaucuaauccgagucgaaaacuggaucuucagaaaccccggcuucgcccuggcagcagccgcaauagccuggcuccucggcagcaguacaucccaaaaagugauauaucucgucaugauacuauugaucgcacccgcauacagcaucagauguauaggcgucagcaaccgugacuucguagagggaaugagcggcgggaccugggucgacaucguccuggaacacggcggaugcguaaccguuauggcacaggacaaacccaccguagacaucgagcuaguaacaaccacagucuccaacauggccgaaguacgcuccuacugcuacgaagcguccauaagcgacauggcaagcgacagccgcugcccaacccaaggggaggcauaccuagacaaacaaagcgacacucaguacgucuguaaaagaacacucguagacagaggauggggcaauggaugcggccuauucggaaaaggcagccucguaaccugcgccaaauucgcaugcaguaagaaaaugaccggaaaaagcauacaacccgagaaucuagaguaccggaucaugcucagcguacacggcucccaacacuccggaaugauaguaaacgacacaggacacgaaacagacgaaaaccgggccaaagucgagaucacaccaaacuccccaagggccgaagccacccugggcgguuucggcagccuaggacuagacugcgaaccccgcaccggccucgacuucagcgaccuauacuaccuaaccaugaacaacaaacacugguuaguccacaaagaaugguuccacgacauaccccucccguggcacgcaggcgcagacaccggcaccccucacuggaacaacaaagaagcacucgucgaguucaaagacgcccacgccaaaaggcaaaccgucgucguacucgggucacaagaaggagccguacacaccgcacuagccggagcccuagaagcagaaauggacggcgcaaaagggagacuauccuccggccaccucaaaugccgacugaaaauggauaaacuacgacuaaaaggcgucagcuacagccugugcaccgcagcauucaccuucaccaagauacccgccgaaacccuccacggaacagucaccgucgaaguccaauaugcaggaacagacggccccugcaaaguccccgcacaaauggccguggacaugcaaacccuuacaccaguaggaagacucaucacagcaaacccggucaucaccgaaagcacggaaaacucgaagaugaugcucgagcuagacccgcccuucggagauagcuauauaguaauaggaguuggagaaaagaaaauaacccaccacuggcacagaagcggguccacaaucggaaaagcauucgaagcgacaguacgaggggccaaacgaauggcaguccucggagacacagccugggacuucggauccguaggaggagcccuaaacucgcucggcaaaggcauacaccaaaucuucggcgccgcguucaaaucccuauucggaggcaugagcugguucagccaaauacuaauagguacccuacucauguggcucggacugaacaccaaaaacggaagcaucagucuuaugugccuagcacucggaggcguacuaauauuccuaucaacagccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10610 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccaugggcaaaagguccgccggaagcauaauguggcuggccagccuagcagucgugaucgcaugcgccggcgcgguaacacgccggggcucggcauacuacauguaccucgaccgaaacgacgccggggaagccaucagcuucccgaccacucucgggaugaacaagugcuacauacagauaauggaccuuggacauaccugcgacgcaacaaugagcuacgaaugcccaauguuagacgagggaguagaaccagacgacguggacugcuggugcaacacaacguccaccuggguagucuacggaaccugccaccacaagaaaggcgaggcgcgaagaagccgccgagccgucacacuacccagucacucaacacggaaacuacaaacaagaucacaaacauggcuagagagcagggaauacaccaaacaccucauccgagucgagaacuggauauucagaaacccaggcuucgcccucgccgccgcggcgauagccuggcuacucgggagcuccacaagccagaaaguaauauaccuagugaugauacuccuaauagcgccugcauacucgauccgaugcauuggaguaagcaaccgcgacuucguggaaggcaugucaggcggaaccuggguagacguaguccuagagcacggaggcugcguaaccguaauggcccaggacaaacccacagucgacaucgagcuagucacgacaaccgucagcaacauggcagaaguacguagcuacugcuacgaagcaucaaucucagacauggcaucagacagucgaugccccacacaaggagaagccuaccuagacaaacagucagacacacaauacgucugcaaaaggacccucgucgaccgaggcugggggaacgggugcggauuguucggcaaaggaucccucguuacaugcgcaaaauuugcauguucgaagaaaaugacugggaaaucaauacaaccggaaaaucuggaauacagaaucaugcuauccguacacggcagccagcacagcgguaugaucgucaaugacaccggccacgaaacugacgaaaacagagcaaaagucgaaaucacgcccaacagcccacgggcggaggccacacucggaggcuucggaucacuaggccuagacugcgaaccacgcaccggccuagacuucagugaccuauauuaccugaccaugaacaacaaacacuggcucguacacaaagaaugguuccacgacauaccccuaccguggcacgcgggggccgacaccgggacaccacacuggaacaauaaagaagcccuaguagaguucaaagacgcgcacgccaaacgccaaacagucguaguacucggcucacaagaaggagccguccacaccgcacucgcaggagcucucgaagcagaaauggacggagccaaaggacgacuuagcagcggacaccuaaaaugcagacucaaaauggacaaacucagauuaaaaggagucagcuacucgcuaugcacagcagcauucaccuucacaaagauccccgcggaaacccuacacgggacggucacaguagaaguccaauacgccggcacggacgggccaugcaagguucccgcacaaauggcggucgacaugcagacacugacaccagucggcagacuaauaaccgcgaaccccguaauaacagaaagcacagagaacucgaaaaugaugcuggaacuagacccaccguucggagacucauauauugugaucggaguaggagaaaagaaaauaacacaccacuggcaucgcagcgggagcacaaucggaaaagcauucgaagcuacaguccgcggcgccaaaagaauggcagugcucggcgacacggccugggacuucggaucaguaggcggagcccuaaacucacuuggaaaaggaauacaccaaauauucggcgcagcguucaaaagucucuucggcgggaugucaugguucagccaaauccucaucggcacccuacuaauguggcucggccuaaaugcaaagaacggcagcauaagccucaugugccuagcccuaggaggaguacuaaucuuccuaaguaccgccguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10611 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggcaagcgaucagccggauccaucauguggcucgccagccuagcaguagucaucgcaugcgcaggggccaucacaagacgaggcuccgcguauuacauguaccuagaccguagcgacgccggaaaggcaaucagcuucgcaaccacccugggagucaacaaaugucacguacaaaucauggaccuaggacauaugugcgacgcaaccaugagcuacgaaugccccaugcuagacgaaggcgucgaacccgacgacguagacugcuggugcaacacaacuucaacaugggucgucuacggaacaugccaccacaaaaagggcgaagcaagacgcucccguagagccgugacccugccaagccacucaaccagaaaacugcaaacaagaucacaaacauggcuagaaagccgcgaguacacgaaacaccucauaaaaguagaaaacuggaucuuccgcaaccccggguucgcacucguagccgucgcaauagccuggcugcucggcuccagcacaucccagaagguaauauaccuagucaugauccugcucaucgcgccagcauacuccauacgaugcaucggcgucagcaacagagauuucguagagggaaugagcggcggcaccuggguagaugucguccuagaacacggaggcugcgucaccguaauggcacaggacaagcccacaguagacauagagcuagucacgacaacagucagcaacauggcagaaguaagaagcuacugcuaugaagcaucuaucagcgacauggcgagcgacagccgaugccccacgcaaggcgaggccuaccucgacaagcaguccgacacucaauacguaugcaaacgaacccucguagaccgggguuggggaaacggaugcgggcuauucggaaaaggcucccuaguaaccugcgccaaauuuaccugcuccaagaaaaugaccggaaaaucgauccaaccagaaaaccuggaauauagaauaaugcucagcguccacggcagccaacauucuggcaugauaggcuacgaaaccgacgaggacagggcaaaagucgagguaacgccaaacagcccaagggcagaagcgacccucggaggauucggcagccucggacucgauugcgaaccccgcacaggccucgacuucucagaccucuacuaccucacaaugaacaacaaacacuggcucguacacaaggaaugguuccacgacauaccacugcccuggcaugccggcgcugauacaggaacaccacacuggaacaacaaagaagcccucguggaguucaaagacgcccacgcaaaacgccaaaccguaguaguccuaggaagccaagaaggcgcgguacacacagcccucgccggagcccuagaagcagaaauggacggagccaaagguagacuauucucuggacaccucaaaugccgauuaaaaauggacaaacuccgacuaaaggguguaucauauagccuaugcacagcagccuucacauucacaaaggugccagcagaaacgcuucacgggaccgucaccgucgaaguacaguacgccggcacagacggaccgugcaaaauaccaguccagauggcaguagacaugcaaacacucacaccggucggcaggcuaauaacagccaacccaguaauaacagaaagcacagagaacagcaagaugaugcuagaguuagacccgcccuucggggacagcuacauaguaauaggcgucggagacaagaaaauaacacaccacuggcaccgaucaggcagcacgaucggaaaagccuucgaagcaaccguaaggggcgccaaaagaauggcaguacuuggagacacagcaugggacuucggaagcgucggcggaguauucaauaguuuaggcaaaggcauacaccagauauucggagccgccuucaaaucacuauucggagggaugucaugguucagccaaauccucauaggcacccuacucguauggcuaggccucaacaccaaaaauggcuccauaagucugacaugccucgccuuaggcggcguaaugauauuccuaucaaccgccguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10612 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggaaaacgcucagcgggaucaauaauguggcucgccucccuagcagucgucaucgccugcgccggagccgucacucgccgcggcuccgcauacuacauguaccucgaccgaaacgacgccggagaagccauaucauuccccacaacccucggaaugaacaaaugcuacauccaaaucauggaccuaggccauaugugcgacgcaacgaugucauacgaaugccccaugcucgacgaaggaguagaacccgacgacguagacugcuggugcaacacaacgagcaccugggucgucuacgguaccugccaccacaagaaaggcgaagcccgcagauccagacgagcaguaacucucccaucccacagcacccgcaaacuacagacaaggucgcaaaccuggcucgaaagcagagaauacacaaaacaccucauccgcguagagaacuggaucuuccgaaaucccgguuucgcccuagcagccgcagcaauagcauggcuccucggcucaagcaccagucaaaaaguaauauaccuagucaugauacuccuaauagcacccgcauacagcauaagaugcaucggcguaucgaaccgcgacuucgucgagggaauguccggaggaacguggguugacguaguacuagagcacggcgggugcguaacuguaauggcccaagacaaacccacaguugacauagagcucgucaccacaacggucucaaacauggccgaaguccggaguuacugcuaugaagcgagcaucagcgacauggcauccgacucccgaugccccacacaaggcgaagccuaccuagacaaacagucagacacacaauacgucugcaaacggacacucgucgacagaggauggggcaacggcugcggccucuucggcaaaggcagccuugucaccugugcgaaauuugccugcagcaagaaaaugaccggcaaauccauacaacccgaaaaccuggaauaccgaaucaugcugucaguccacggaucccaacacagcggaaugaucguuaacgacacaggucacgaaaccgacgaaaauagagccaaaguagaaauaacaccgaacagcccccgagccgaagccacacuaggagguuuuggcucccucggccucgacugcgagccacgcaccggacucgauuucucagaccucuacuacuuaacgaugaacaacaaacacuggcucguccacaaagaaugguuccacgacaucccccucccauggcacgcaggagcagacacaggcacaccacacuggaacaacaaggaagcccuagucgaguucaaagacgcccaugccaaacgccaaaccguagucgugcucgguucacaagaaggcgccguccacacggcacucgccggagcacucgaagccgaaauggacggcgcaaagggacgacuauccucaggccaccucaaaugcagacucaaaauggacaaacuaaggcuaaaaggcguaagcuacucccuauguacagcagcauucacauucaccaaaaucccagcagaaacacuucacggcacagucacaguagaaguccaauacgccgggacagacgggccaugcaaagugccggcacagauggccguagacaugcaaacccuaacccccguaggccgucucaucaccgccaacccaguaaucaccgaaagcaccgaaaacuccaaaaugaugcuagaacucgacccacccuucggggacaguuacaucguaaucggaguaggggaaaagaaaaucacccaccacuggcaccgauccggcuccaccaucgggaaggcuuucgaagcaacgguacgcggcgcaaaacggauggcgguacucggagacacagccugggacuucggcagcgucggcggagcccugaacucacuagggaaaggaauacaccaaaucuucggcgccgccuucaaaucgcuauucgggggcaugagcugguucucacaaaucuuaaucggaacccuacucaugugguugggccugaacaccaagaacggauccaucucacugaugugucuagcucucggcgggguacucaucuuccugagcaccgcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10613 - RNA, 2470 nt, Artificial Sequence
  ZIKV (strain ZikaSPH2015) prME-short variant mRNA Design 2 opt
ggggcgcugccuacggagguggcagccaucuccuucucggcaucaagcuuaccauggccaucucaggcguaccaguccuaggguucuucaucaucgccguccucaugagcgcccaagaauccugggccguaacccgccgaggauccgccuacuacauguaccuagacagaaacgacgcaggagaagccaucuccuucccgacaacacucggaaugaacaaaugcuacauacaaaucauggaccucggccacaugugcgacgcaacaaugagcuacgaaugucccaugcuagacgaaggagucgaacccgacgacgucgacugcuggugcaacacuaccagcaccuggguggucuacggaaccugccaccacaaaaagggcgaagcacgacgaaguagacgcgccgucacccuccccagccacucaacacguaaacuacaaacccgaagccagaccuggcucgaaagccgagaauacaccaaacaccucaucagaguagaaaauuggaucuucagaaaccccggguucgcacuggcggcagccgccaucgccuggcuacucggaucuagcacgucccaaaaggucauauaccuggucaugauccuacuuaucgccccagcauacuccauccgcuguauaggcguauccaaccgugacuuugucgaaggcauguccggcggaaccugggucgacauaguccucgaacacggcggaugugucaccguaauggcacaggacaaaccaacagucgacaucgagcuaguaaccaccaccgucuccaauauggcagaaguaagauccuacugcuacgaagccucaaucagcgacauggccucagacagccgaugccccacacaaggcgaagcauaccuagauaagcagucagacacccaguacgucugcaagcgcacccuagucgaccgcggauggggaaacggcugcgggcuauucggaaaaggaagccuaguaaccugcgccaaguucgcuuguucaaagaaaaugaccggaaaauccauacaaccagaaaaccucgaauaccgcaucaugcuauccguacacggcucacaacacagcggcaugauaguaaacgacaccggacacgaaaccgacgaaaaccgggccaaagucgaaauaacaccgaauagcccccgcgccgaagcaacccucggcggauucggaucccucggguuagacugcgagccccgcacuggccucgacuucuccgaccuauacuaccucaccaugaacaacaaacacuggcugguccacaaagagugguuccacgacaucccccugccauggcacgcaggagccgacaccggcacaccccacuggaacaauaaagaagcucuaguagaguucaaggacgcacaugcaaaacgacaaaccgucgucguccuaggcucccaagaaggagcaguacacaccgcccucgcaggagcccucgaagccgaaauggacggagccaaagggcgacucuccucaggacaccuaaaaugucgccuaaaaauggacaagcuaaggcucaaaggaguaagcuacucccucugcaccgcggcauucaccuucacaaaaauccccgcugaaacacuccacggcaccgucacaguggaaguacaauacgccggaacagacgggccgugcaaaguaccagcccaaauggcggucgacaugcagacccucaccccagucgggcgccucaucacggccaacccaguaauuacggaaucaaccgagaacuccaaaaugaugcucgaacuggaucccccauucggcgacagcuacaucgucaucggcguuggcgaaaagaaaauaacacaccacuggcacagauccggcagcacacucggcaaagcguucucuacaacacucaaaggugcacaacgacuagcugcacucggcgacacagcaugggacuucggauccaucggcggagucuucaacuccaucgggagagcaguccaccagguuuucgggggcgccuuccgaacacuauucggagggaugagcuggaucacgcaaggacuaaugggagcccuccuacuauggaugggcguaaaugcaagagaccggagcauagcacucgccuuccuagcaaccggaggcguccucgucuuccuagccacaaacguccacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10614 - RNA, 2470 nt, Artificial Sequence
  ZIKV (isolate Z1106033) prME-short variant mRNA Design 2 opt
ggggcgcugccuacggagguggcagccaucuccuucucggcaucaagcuuaccauggccaucagcggcguccccguccuaggcuuuuucaucauugccguacucaugucagcccaagaaagcugggccguaacccgacgcggcagcgccuacuacauguaccuagaccgaaacgaugcaggggaagcaaucuccuuccccaccacgcuaggaaugaacaaaugcuacauucaaauaauggaccucggccauaccugcgacgccaccaugucauacgagugccccauguuagacgaaggaguagaacccgacgauguggauugcuggugcaacacaacaagcaccugggucguguacgggaccugccaccacaagaaaggagaagcgcgcagaucacgcagggcagucacgcuacccagccacucaacacggaaacugcaaacccgcucccaaacauggcuagagucacgggaauacaccaaacaccugauccgagucgaaaacuggaucuuuagaaacccaggauucgcccucgccgcagcugcuaucgccuggcuccucgggucaucaacaucccagaaaguuaucuaucucguaaugauccuccuaaucgcccccgccuacuccauccgcugcauaggagugaguaacagagacuucguggaaggcauguccggcgggacauggguagacgucguacucgaacacgggggaugcguaacagugauggcucaagauaaaccaacaguagacaucgaacucguuacgacaaccgucagcaacauggcagaaguccgaagcuacugcuacgaggcaagcauaagcgacauggccucagacagccgaugcccuacccaaggcgaagcauaccuagacaaacaaagcgacacccaauacgucugcaaaagaacgcucguggaccguggcuggggaaacggcugcggccuauucggaaaaggaagucugguaaccugcgccaaauucgcgugcuccaagaaaaugaccggcaaauccauccaaccugaaaaccucgaauaccggaucaugcuauccguccacggcagccaacacucaggcaugaucgucaacgacacaggacacgaaaccgacgaaaaucgagccaaaguagaaauaacacccaacagcccaagagcagaagcaacacuaggcggauucgggagccucggacucgacugcgagccacgcacagggcuagacuucucagaccucuacuaccuaaccaugaacaacaaacacuggcucguccacaaagaaugguuccacgacauaccacuccccuggcacgcaggggccgacaccggcacgccacacuggaacaacaaagaggcacuuguagaguucaaagacgcccacgcaaagcgacaaaccgucguaguucucggaucccaagaaggcgccguccacacggcccucgccggagcacuagaagcagaaauggacggcgccaaaggaaggcuaaguuccggccaccucaaauguagacucaaaauggacaaacuucgacuaaaaggagucagcuacagcuuaugcaccgccgcauucacauucacaaaaaucccagcagaaacacuacacggaaccgucacagucgaaguacaauacgcgggcacagacggcccauguaaggugcccgcccaaauggcaguggacaugcaaacccuaacccccguagggcgacucaucacggcaaacccagucaucaccgaaagcacagaaaacagcaaaaugaugcucgaacucgacccaccuuucggggacuccuacauagucaucggcgucggcgaaaagaaaauaacccaccacuggcacagaucaggcaguacccuuggaaaagccuucucaaccacuuuaaaaggugcacaaagacuagcugcacucggcgacaccgcaugggacuucggcucgauaggcgggguauucaacagcauaggacgagcgguccaccaagucuucggcggcgcauuccggacacuguucggaggaauguccuggauaacccagggacucaugggggcccuacuccucuggaugggaguaaacgcgagagaccgcuccaucgcccuagcauuccuagccacaggaggcguccuaguuuuccucgcaacaaacguacaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10615 - RNA, 2458 nt, Artificial Sequence
  ZIKV (strain MR 766) prME-short variant mRNA Design 2 opt
ggggcgcugccuacggagguggcagccaucuccuucucggcaucaagcuuaccauggccaucucagggguaccaguacuaggcuucuucaucauagccguccucaugucagcccaagaaucaugggcgauaacacgccgaggcagcgcuuacuauauguaucucgaucgaagcgacgccggaaaagccaucaguuucgcuaccacucuaggaguuaacaaaugccacguacaaaucauggaucugggccacaugugcgacgccaccaugagcuacgagugcccaaugcucgacgaaggaguagaaccggacgacgucgacugcuggugcaacaccaccaguacauggguugucuacggcacuugccaccacaagaaaggagaagcccgacgaucccgccgcgcggucacucuccccucccacuccacacgaaaacuccaaacccgcucacaaacguggcuagagucgcgagaauacaccaaacaccucauaaaaguagaaaacuggaucuuccgcaacccaggcuucgcacucguagcgguugcgaucgcguggcuccuaggcuccuccacuucccaaaaagucaucuaccuaguuaugauccuccuaaucgccccagccuacagcauccggugcaucggagucucaaacagagacuucgucgaagguaugagcggcggcacauggguagacgugguccucgaacacggcggaugcgucacaguuauggcgcaagacaaacccaccguagacaucgaacucgucacgaccaccgugucaaacauggccgaaguccgaagcuacugcuacgaagcaucaauaucagacauggccuccgacucccguugcccaacgcaaggagaagccuaccucgacaaacaaagcgacacccaauacguuugcaaacgcacccuagucgaccgcggcuggggcaacggaugcggccucuucggaaaaggcucccucgugacaugcgcaaaauucacaugcagcaagaaaaugacaggaaaaucaauccaacccgaaaaccucgaauacagaaucauguugucaguacacggcagccaacacucaggaaugauaggauacgaaacggacgaagaccgcgcaaaagucgaagucaccccaaacagccccagggccgaggcgacccuuggaggauucggcagccucggacucgacugcgagccccgcacaggccucgauuucagcgaucuauacuaccuuaccaugaauaacaaacacugguuaguccacaaagaaugguuccacgacauaccccuccccuggcacgcgggagcggacaccgguaccccacacuggaacaacaaagaagcacucgucgaguucaaagacgcccacgccaaaaggcaaacaguaguaguccucggaagucaagaaggcgccguccacaccgcacuggccggcgcccucgaagccgaaauggauggagccaaaggccgacucuucucaggacaccucaaaugccgacucaaaauggacaaacucagacuaaaaggaguauccuacagccuuugcacagccgccuucacguucacaaaaguccccgccgaaacacuucacggaacggucacagucgaaguacaauacgccggcaccgacggccccugcaaaauccccguucaaauggcgguggacaugcaaacucucacaccuguaggacgacuaauuaccgccaaccccgucaucacugaauccacagaaaacagcaaaaugaugcuagaacucgaucccccauucggcgacagcuacauaguaaucggugucggcgacaagaaaaucacacaccacuggcaccgcagcggcuccacacuuggaaaagcauuuucaaccacccucaaaggcgcacaaagacuagccgcgcucggagacacagcaugggacuucggcucgaucggcggagucuucaacuccauaggacgagccguccaccagguauucggcggagccuuccgcacacuguucggaggcaugagcuggaucacucaaggacucaugggagcgcuccuacucuggaugggcgucaacgcccgcgaccgaagcauagcuuuagccuuccucgccacaggaggcguccucgucuuccucgcgaccaacguacacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10616 - RNA, 2470 nt, Artificial Sequence
  ZIKV (strain NatalRGN) prME-short variant mRNA Design 2 opt
ggggcgcugccuacggagguggcagccaucuccuucucggcaucaagcuuaccauggcgaucuccggcguaccaguccuaggauucuucaucaucgcaguccucaugucugcacaagaaucaugggcaguaacaagacgcggguccgcauacuacauguaccucgaucgaaacgaugccggcgaagccauauccuuccccacaacacuaggcaugaacaaaugcuacauccaaaucauggaccuaggacacaugugcgacgcaacaauguccuacgaaugcccaaugcuggacgaggggguggaaccagacgacguagauuguuggugcaacacaaccuccaccugggugguauacggaacgugccaccacaaaaagggagaagcccgacgcagccgacgagccgugacccuacccucccacagcacacgaaaacuacaaacacgcagccaaacauggcuagaaagcagagaauacaccaaacaccuaauacgcguagaaaacuggaucuuccgcaacccaggcuucgcacuggccgcagccgccaucgcauggcuccucggcagcucaaccucccaaaagguaaucuaccuuguuaugauccuccuaaucgcaccggcguacuccauaagaugcaucggcgucucaaauagggacuucguagaaggcaugagcgggggaacguggguagacguaguccucgaacacggaggcugcguaaccgugauggcacaagacaaaccaacgguagacaucgagcuaguaacaacaaccgucuccaacauggcugaagucagauccuacuguuacgaagccagcauaagugacauggccucagacucacgcugccccacacaaggcgaagcauaccuagacaaacaauccgacacccaguacgucugcaagcgaacccucgucgacagaggcuggggcaacggauguggccuauuuggaaagggaagccucguaaccugcgcuaaauucgccugcucaaagaaaaugacaggcaaaagcauccaacccgaaaaccuggaauaccgcaucaugcuaagcguccacggcagccaacacucagggaugauaguaaaugauaccggacacgaaacagacgaaaaccgagcaaaaguggaaauaacaccaaacucgccacgggccgaagccacgcuagggggcuucggcucacuagggcucgauugcgagccaagaaccggacuagauuucagcgaccuauacuaucuaacgaugaacaacaaacauuggcuaguacacaaagaaugguuccacgacaucccccuaccauggcacgccggcgccgacaccggcacaccacacuggaacaacaaagaagcacucguggaguucaaagaugcccacgccaaaagacaaacagucgugguacuaggcagucaagaaggcgccgugcacacagcucuugcgggagcccuagaagccgaaauggacggcgccaaaggaagacuaagcuccgggcaccucaaaugccgacuaaaaauggacaaacucagacugaaaggcgucagcuacucacucugcacagcagccuucacauucaccaaaauucccgcagaaacacuacacggcacaguaaccgucgaaguccaauacgcaggcacagacggccccugcaaaguccccgcacaaauggccguagacaugcaaacacuaacacccguaggucgacuaauaaccgcgaacccagucaucacagaauccacugaaaacagcaaaaugaugcuagaacucgacccgccauucggagacucauacaucguaaucggagucggagagaagaaaauaacacaccauuggcaccgcucgggcuccacacuaggcaaagccuucagcacaacccucaaaggagcacaaagacuggccgcacucggcgacaccgcgugggacuucggcagcaucggaggcguguucaacucaauaggacgugccguacaccaagucuucggcggagccuuccgaacacuauucggcgggaugucauggauaacccaaggccuaaugggcgcccuacuccuauggaugggaguaaacgcacgggaccgcucgauagcacuagcuuuccucgcaacgggcggcguccuaguguuucuagcaacaaacguucacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10617 - RNA, 2449 nt, Artificial Sequence
  ZIKV (strain ZikaSPH2015) prME-short variant mRNA Design 2 opt
ggggcgcugccuacggagguggcagccaucuccuucucggcaucaagcuuaccauggacuggaccuggauacuauuccucguagccgccgccacccggguccauucagucacccgccgaggcucugccuacuacauguaucuggacagaaacgacgccggcgaagcaauuagcuucccaacaacccucggaaugaacaaaugcuacauacaaauaauggaccucggccacaugugcgacgcaaccaugucauacgagugcccaaugcuggacgagggagucgaacccgacgacguagacugcuggugcaacaccaccagcaccugggucguauacggcacaugucaccacaagaaaggggaagcccgacguagccgcagagcaguaacccuaccaagucauucaacacgcaaacuccaaacaaggagccaaaccuggcuagaaucacgggaguacacaaaacaccucauacgaguagaaaacuggaucuucagaaacccgggguucgcccucgcagccgccgccauagcauggcuucucgggucaagcaccucccaaaaaguaaucuaccucgucaugauacuacuaaucgcaccagcauacagcauacgaugcaucggcguaucaaacagagacuucguagaaggcaugaguggagggaccuggguugacauaguacuggaacacggcggaugcgucacagucauggcacaggacaaaccaaccgucgacauagagcuuguuacaaccacggucagcaacauggccgaaguccgaagcuacugcuacgaggcaagcauaucagacauggccucagacagccgaugcccaacgcagggagaagcauaccucgacaaacaaagcgacacgcaauacgucugcaaaaggacgcuuguagaccgcggcuggggaaacggaugcggccucuuuggaaaaggaucucuaguaaccugcgcaaaguucgcgugcucaaagaaaaugacuggaaaaucaauccaacccgagaaccucgaauaccgcaucaugcuauccguccacgggucacaacacagcggaaugaucguaaacgacacaggacacgaaacagacgaaaacagggccaaaguagagaucaccccgaacagcccaagagccgaagcaacacuaggcggcuucggcagucuuggacucgacugcgaaccgcggacuggacuggacuuuagcgaccuguacuaucucaccaugaacaacaaacacuggcuaguacacaaagaaugguuccacgacaucccgcucccauggcacgcaggcgccgauaccggaaccccucacuggaacaacaaagaagcccucguagaguucaaagacgcccacgccaaacgacaaacaguagucgugcucggaagccaagaaggagcgguacacacggcacucgcgggagcccuggaagcggaaauggacggcgcaaaaggacgacuaucaagcggucaccucaaaugccgacuaaaaauggacaagcuacgccucaaaggcgucagcuauagccuaugcacagccgcauucacauucacaaaaauaccggccgaaacacuacacggcaccgucaccgucgagguacaauacgcagguaccgacggacccugcaaagucccagcccagauggcagucgacaugcaaacccucaccccugucgggaggcuaaucaccgcaaaccccguaauuacagaaucaacagagaacagcaaaaugaugcuggaacuggacccacccuucggcgacuccuacaucgucaucggaguaggugaaaagaaaaucacccaccacuggcaccgaagcggcucaacccuaggcaaagccuucagcacaacccuaaaaggagcccaacgccucgccgcccucggcgauacggcgugggacuucggcuccauaggaggcguauucaauucaaucggccgcgccguacaccaagucuucggcggagcauuccggacacucuucggaggaaugagcuggauaacgcaaggacucaugggcgcauuacucuuauggauggggguaaacgcccgagaccguagcaucgccuuagccuuccucgccacaggcggagugcuaguauuccucgcaacaaacguccacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10618 - RNA, 2449 nt, Artificial Sequence
  ZIKV (isolate Z1106033) prME-short variant mRNA Design 2 opt
ggggcgcugccuacggagguggcagccaucuccuucucggcaucaagcuuaccauggacuggaccuggauacucuuccugguagccgcagcuacccgcguacacucagucacacgccgaggaucggccuacuacauguacuuagaccgcaacgacgcuggcgaagcaauaucauuccccacaaccuuaggcaugaacaaaugcuacauacaaaucauggaccugggccacacaugugacgcgaccauguccuacgagugcccaaugcuggacgaaggaguagagccggacgacguagacugcuggugcaacaccaccagcacauggguagucuacggaaccugccaccacaagaaaggcgaggcccgccgaagccgaagggcagucacccucccaagccacuccacccgaaaacuacagacccgcucccaaaccuggcuagaaucucgugaauacacaaaacaccucaucaggguagaaaacuggaucuuccgcaaccccggcuucgcacucgcagcagccgcaaucgcuuggcuacugggcuccuccaccucacaaaaaguaauauaccuggucaugauccuacugaucgccccagccuacagcauccgcugcaucggcguaagcaaccgggacuucguagaaggcaugucuggcgggaccuggguagacgucgugcuagagcacggcggcugcgucacaguaauggcacaagacaagcccacagucgacaucgaacucgucaccaccaccguaagcaacauggcagagguccgcuccuauugcuacgaggccagcauaucagacauggcaagcgacagccggugcccaacccaaggcgaagcauaccucgauaaacaauccgacacgcaauacguaugcaaacgaacacucgucgacagaggcuggggaaacggaugcggccuauucggaaaaggaucccuagucaccugugccaaauucgccugcaguaagaaaaugacaggcaaaagcauacaaccagaaaaccuagaauaccgaaucaugcucuccguacacggaagccaacacucaggaaugaucgucaacgacacugggcacgaaaccgaugaaaaccgugcaaaaguagaaauaacgcccaacucaccacgcgcagaagccacccugggaggcuucggcagccuaggacucgacugcgaaccaagaacuggccucgacuucucagaccucuacuaccucaccaugaacaacaaacacuggcucguacacaaagagugguuccacgacaucccccuaccauggcacgcuggggcggacacaggcacaccccacuggaacaauaaagaagcccuaguagaguucaaagacgcacacgcaaaacgacaaaccguagucguacuuggcagccaggaaggugcgguccauaccgcacuagccggcgcccucgaagccgaaauggacggcgcuaaaggucgccucucaagcggccaucuaaagugccgacuaaaaauggacaaacuccgucucaaaggagucuccuacagccugugcaccgcagcauucaccuucacaaaaaucccagcggaaacccuccauggaaccgugaccgucgaaguccaauacgcaggaacagauggacccugcaagguccccgcccaaauggcaguagacaugcaaacacugacccccgucggccgacucauaacggccaacccagucauaacugaauccacagaaaacucaaaaaugaugcuggagcucgacccgcccuucggcgauagcuacauagucaucggcgugggcgaaaagaaaauaacucaccacuggcaccgcagcggcaguacacuaggcaaagccuucaguaccacccugaaaggagcccaacgacucgcagcccucggagacacagcaugggacuucgguagcaucggcggcgucuucaacuccaucgggagagccgugcaccaaguguucggaggcgccuuccguacccucuucggaggaaugucauggauaacucaagggcucaugggcgcccuccuacucuggaugggaguaaacgccagagacagaagcaucgcccuagccuuccuagccaccggcggaguacucguauuccuggcaaccaacguccacgcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10619 - RNA, 2437 nt, Artificial Sequence
  ZIKV (strain MR 766) prME-short variant mRNA Design 2 opt
ggggcgcugccuacggagguggcagccaucuccuucucggcaucaagcuuaccauggauuggaccuggauccuguuccucguagccgccgccacacgcguacauucaauaacacgccgaggaucggcauacuacauguacuuggaccguagcgacgcaggcaaagcgaucuccuucgccacaacccugggcgucaauaaaugccacguacaaaucauggaccuuggacacaugugcgacgccacaaugucauacgaaugccccaugcuggacgagggcguagaaccagacgacgucgacugcuggugcaauaccacaagcacaugggucguuuacggcacaugccaccacaagaaaggggaagcgcgacggucccgacgagcggugacacuaccaucccacagcacacgcaaacuacaaacaaggagccaaaccuggcucgaaagccgagaguacacaaaacaccuaauuaaaguagaaaacuggaucuuccgcaauccaggauucgcgcuaguagcagucgccauagccuggcuacuaggaagcagcaccucccagaaagucaucuaucuagucaugauccucuuaauagcacccgcguacaguauacgaugcauaggcguaagcaacagggauuucguagaaggaaugucgggagggaccuggguagacgucgugcucgagcacggcgggugcguaaccguaauggcccaagacaaacccacagucgacaucgaacucguuacaaccacaguuagcaauauggccgaaguaaggucauacugcuacgaagcaucgaucagugacauggcaucagacucacggugccccacgcaaggcgaagcauaccuagacaaacaaagcgacacccaauacgucugcaaacgaacacucgucgaccgaggcuggggaaacgggugcggacucuucggcaaaggcucgcugguaaccugcgcaaaauuuacauguucaaagaaaaugacaggcaaaagcauucaacccgaaaaccucgaguaccgaaucaugcuaucaguccacggaagccaacacagcggaaugaucggguaugaaaccgacgaggacagagccaaaguagaaguaacgccaaacagcccccgggccgaagccacacugggcggauucggaagccucggccuggacugcgaacccagaacaggccuggacuucagcgaccuauacuaccuaaccaugaacaacaaacacuggcucguacacaaagagugguuccacgacaucccccucccauggcacgcaggagccgacaccggcacaccccacuggaacaacaaagaagcccuggucgaguucaaagacgcccacgcgaaacgacagaccguagucgugcuaggaagucaagagggggcaguacacacagcccucgccggagcacucgaggccgagauggacggcgcaaaaggacgccucuucucgggacaccuaaaaugccgccucaaaauggauaaauuaagacuaaaaggcgucucauacucguuaugcaccgccgcauucaccuucaccaaaguccccgccgaaacccuacauggaacaguaaccguggaaguacaguacgcggggaccgacggacccugcaaaaucccaguccagauggcggucgacaugcaaacccugacgcccgucggacgccuaauaacggcuaacccggugauaaccgaauccacagaaaacucaaaaaugaugcucgaacuagacccaccauucggagacagcuacaucguaauaggagucggcgacaagaaaaucacccaccacuggcaccgaaguggauccacacuaggcaaagcauucucaaccacacucaaaggggcccagcggcucgccgcccuaggagacacagcaugggacuucggaucaaucggagguguauucaacucgauaggcagagccguccaccaaguauucggaggggcauuccgaacacuauucgggggaaugagcuggaucacacaaggacucaugggagcccugcugcuuuggaugggcguaaacgccagagaccgaucaauagcccuagcauuccuugcaacaggaggcguccucgucuuccuagcaacaaacguacacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10620 - RNA, 2449 nt, Artificial Sequence
  ZIKV (strain NatalRGN) prME-short variant mRNA Design 2 opt
ggggcgcugccuacggagguggcagccaucuccuucucggcaucaagcuuaccauggacuggacauggauccucuuucucguagcggccgcaacccgaguccacagcgugacccgccgcggcuccgccuacuacauguaccucgacagaaacgacgccggcgaggcaaucuccuucccgaccacccucggaaugaauaaauguuacauacaaaucauggaccucgggcacaugugcgacgcaaccaugagcuacgaaugccccaugcuggacgaaggaguagaaccagacgacgucgauugcuggugcaacaccacaagcaccuggguaguauauggcacaugucaccacaaaaagggggaagcccgccgcucacgccgcgccguaacacucccaucacacagcacccgcaaacuccaaaccagaucccaaaccuggcucgaaucaagagaguacacaaagcaccuaauacgcguagaaaacuggauuuucagaaacccaggcuucgcucuugcagccgccgcgaucgccuggcuccucggcuccaguacaagccagaaggucaucuaccucguaaugauccuccuaaucgcaccagccuacuccauacgcugcauagguguaucaaaccgagacuucguagaaggaaugagcggcggaacaugggucgacguaguacuagaacacggcggcugcgucacagucauggcacaggauaaaccaacggucgacaucgaacucguaaccacaacaguaagcaacauggcagagguccgaagcuacugcuacgaggccuccauauccgacauggcauccgacuccaggugccccacccaaggagaagccuauuuagacaaacaauccgacacccaauacgucugcaaaagaacacugguggaucgaggaugggggaacggcugcggauuauucggaaaaggaucacucguaaccugcgcaaaauucgcaugcagcaagaaaaugacaggcaaaagcauccagccggaaaaccucgaauaccgcaucaugcuaucaguacacggaucccaacacuccggcaugaucgugaacgacacaggacacgaaacggacgaaaaccgggccaaggucgaaauaacaccuaacucaccccgagccgaagcgacucucggaggguucgggagccucggccucgacugcgagccacgcaccggccuagacuuuucagaccucuauuaccucaccaugaacaacaaacacuggcuaguccacaaagaaugguuccacgacaucccacuaccuuggcacgccggcgccgacacaggcacaccccacuggaauaacaaagaagcacuggucgaauuuaaagacgcacacgccaaacgacaaacagucgucguacuaggaucacaagaaggagcaguucacaccgcccuagccggagcacuugaagcagaaauggacggagcaaaaggacgccuuagcucaggacaccuaaagugcaggcugaagauggacaaacugagacucaaaggagucuccuacucacugugcaccgcagccuucacauucacaaagauccccgcagagacucuccacggaaccgucaccgucgaaguacaauacgcaggaacagacggcccuugcaagguccccgcccaaauggcagucgacaugcagacacucaccccagucggaagacucaucacagccaaccccgucauaaccgaauccaccgaaaacucaaaaaugaugcucgaacuggacccacccuucggugacagcuacaucgucauagggguaggagaaaagaaaaucacacaccacuggcaccgcucaggauccacccucggaaaagccuucucaaccacacucaaaggcgcacaaagacucgcggcacucggagacaccgcgugggacuucggauccaucggcggcguauucaacagcauaggacgcgcaguccaccaaguauucggaggagccuuucgaacacucuucggcggaaugucauggaucacccaaggccuaaugggcgcccuacuccucuggaugggagugaacgcccgcgaccggagcaucgcacuagcuuucuuggcaacaggcggcguccuaguauuccuggccaccaacguacacgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10621 - RNA, 2467 nt, Artificial Sequence
  ZIKV (strain ZikaSPH2015) prME-short variant mRNA Design 2 opt
ggggcgcugccuacggagguggcagccaucuccuucucggcaucaagcuuaccaugggcaaaaggucagcgggcagcaucauguggcucgccucccucgcuguagugaucgccugcgcaggagcgguaacgcgccgaggcucagcauacuacauguaucuggaccgaaacgaugccggagaagcaauauccuucccaacaacacuaggcaugaacaaaugcuacauacaaauaauggaccuaggccacaugugcgacgcaacgaugucauacgaaugcccaaugcucgacgaaggcguugaaccagacgacgucgacugcuggugcaacacaacgagcacgugggucguauacggcacaugccaccacaagaaaggagaagcacgccggagccgucgggcagucacccugccaucccacuccacaagaaaacuccaaacacgaagccagacauggcucgagagcagagaauacaccaaacaccuaaucagagucgaaaacuggauauuccgaaaccccggguucgcgcucgcagccgccgcaaucgccuggcuacuaggaucaucaaccagccaaaaaguaaucuaucuaguaaugauacuacuaauagccccggcguacuccauaagaugcauaggcgucaguaaccgagauuucguagaaggaaugucaggagggacaugggucgacaucguacuagagcacggcggcugcgugaccguaauggcacaggacaaaccaacgguagacaucgaacucgucaccacaaccguaaguaacauggcagaagugagaucauauugcuacgaagccuccauaagcgacauggccagcgacucuagauguccaacgcaaggagaagcguaccucgacaaacaguccgacacgcaauacgucugcaaacgcacacucguggaccgcggcuggggaaacggaugcggacuauucggaaaagggucccuagucacaugcgcaaaauuugcgugcucaaagaaaaugacaggcaaauccauccagccagaaaaccuagaauacagaaucaugcucuccguacacggcucccaacacagcggaaugaucguaaacgacacaggacaugaaacggacgagaacagagcaaaagucgaaaucacgcccaauagcccacgcgccgaagcaacccuuggaggcuucggcagcuugggccuugacugcgaaccacgcacggggcuagacuucucagaccuauacuaccuaacaaugaacaacaaacacuggcucguccacaaagagugguuccacgacaucccccucccguggcacgccggcgcagauaccggcacaccccacuggaacaacaaagaagcccuagucgaguucaaagacgcacacgccaaaagacaaacagucgugguacuaggaucccaagaaggagcaguccacacagcgcuagcaggcgcccuagaggccgagauggauggagcgaaaggacgucuauccucaggacaccuaaaaugcaggcuaaaaauggacaaacuacgacuaaaaggcgucucuuacucacuaugcacagccgcauucacauuuaccaaaaucccagcggaaacacugcacggcacaguaaccguagaaguacaauacgcaggcaccgacggacccuguaaggucccagcccaaauggcagucgacaugcaaacacugaccccggucggacgccugauaacagccaacccaguaaucacagaaucgacagaaaauuccaaaaugaugcuagaacuagaucccccauucggcgacagcuauaucgugaucggaguaggggaaaagaaaaucacccaccacuggcaccgauccgggagcacgcucggaaaagcguucucaaccacacugaaaggggcacagcggcucgcagcacucggcgacaccgcaugggacuucgggucaaucggaggcgucuucaacuccaucggacgagcaguacaccaagucuucggaggcgcguucagaacauuauuugggggcaugagcuggaucacacagggccucaugggcgcccuacuccucuggaugggggugaacgccagagacagauccauugcacuagcguuccuagcaacgggcggcguacucguauuccuagccacaaacguccaugccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10622 - RNA, 2467 nt, Artificial Sequence
  ZIKV (isolate Z1106033) prME-short variant mRNA Design 2 opt
ggggcgcugccuacggagguggcagccaucuccuucucggcaucaagcuuaccauggggaaaagaucagcaggcuccaucauguggcucgccucacucgcaguagucauagcaugcgcaggcgcggucaccagacgaggcucagcguacuacauguaccuugacaggaacgacgcaggagaagccaucagcuucccgaccacacucggcaugaacaaauguuacauccaaaucauggaccuaggacauaccugcgacgccacaaugucauacgaaugcccaaugcuagacgaaggcguagaacccgacgacgucgacugcuggugcaacaccacgagcaccugggucgucuacggcacaugccaccacaagaaaggagaagcccgccgaucccgccgagcagucacccuccccagccacucuaccagaaaacuacaaaccagaagccagaccuggcucgaaucaagggaauacacaaaacacuuaaucagggucgaaaacuggauauuccguaacccaggguucgcccucgcggcagccgccauagcauggcuacugggcucgagcacuagccagaaaguaaucuaccucgucaugauauuacugaucgcaccagccuacucaaucagaugcauaggcguaagcaaccgcgacuucguagaagggaugucagguggaacaugggucgacgucguacucgaacacggcgguugcgucacaguaauggcucaggacaagcccacgguagacauagaacuuguaacaacaaccguaagcaacauggccgaaguacgcuccuacugcuacgaagccucaaucucagacauggcauccgacuccagguguccaacgcaaggggaagcguaccuagacaaacaauccgacacacaauacgucugcaaaagaacccuggucgaccgaggcuggggcaacggaugcgggcuauuuggcaaaggcucccuaguaaccugugccaaguucgcaugcuccaagaaaaugaccggcaaauccauacaacccgaaaacuuagaauacagaauaaugcuaucuguucacggaucccaacacagcgggaugauagucaaugacacaggacacgaaacagacgagaacagggccaaaguagaaauaacccccaacagcccacgcgcagaagcuacacugggcggauucggaucucuaggccuagacugcgaaccacgcaccggccuagacuucucagaccucuacuacuugaccaugaauaacaaacacugguuaguccacaaagaaugguuccacgacauaccacuccccuggcacgccggcgcagacacaggcaccccacacuggaacaacaaagaagcccucgucgaguucaaagacgcacacgcgaaacggcagaccgucguaguccucggaagccaagaaggagcgguccacacagcccuagcaggcgcacuagaagcagaaauggacggcgcgaaagggcgacuguccucagggcaccucaaaugucggcucaaaauggacaaacuacgccuuaaaggcguaucguacucacuaugcaccgcggccuucacauucaccaaaauccccgccgaaacacuacauggaaccguaaccgucgaaguacaauacgcaggcaccgaugggcccugcaaagucccugcacaaauggcagucgacaugcaaacacucaccccagucggccgacuaaucacagcuaaccccgugauaacggaguccacagaaaacucgaaaaugaugcucgaacuagacccgcccuucggcgacagcuacauaguuaucggagucggugaaaagaaaauaacccaccacuggcaccgaagcggaagcacccucggaaaagccuucuccaccacccucaaaggcgcccaaagacuagcagccuuaggcgacaccgcgugggacuucggaucuauaggcggaguauucaacuccauaggacgcgcaguccaccaaguauucgggggagcauucagaacacucuucggcgguaugagcuggaucacacaaggccucaugggagcacuccuacucuggaugggcgucaacgcaagggacagauccaucgcccucgcguuucuagcgaccgggggagugcucguauuccucgccacgaacguccacgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10623 - RNA, 2455 nt, Artificial Sequence
  ZIKV (strain MR 766) prME-short variant mRNA Design 2 opt
ggggcgcugccuacggagguggcagccaucuccuucucggcaucaagcuuaccaugggaaaacgcagcgccggauccaucauguggcuagcaucgcucgcaguaguaaucgcgugcgccggugcaaucacacgacgcggcagcgcauacuauauguaccucgaccgaagugaugccgggaaggcgaucucauuugcaaccacgcuaggcguaaauaaaugccacguccagaucauggaccucggccacaugugcgacgccaccaugagcuacgaaugcccgaugcuggacgaaggcguggaacccgaugacgucgacugcuggugcaacacaacaagcaccuggguugucuacggcacgugccaccacaagaaaggcgaagcaagaaggucacgacgagcaguaacgcuaccaagccacagcacacgcaaacuacaaaccagaucacaaacauggcucgagagccgcgaauacaccaaacaccuuauaaaaguagaaaacuggauauucagaaacccgggauucgcccuaguagcaguagcaauagcauggcuacugggcucguccacgagucaaaaaguaauauaccuaguaaugauacuacugauagcacccgccuacucaauccggugcaucggaguauccaacagggacuucguagaagggaugucaggcgggacauggguagacgucguccuagagcacggcggaugcgucacgguaauggcccaagacaaacccacaguagauaucgagcuaguaaccacgaccguaagcaacauggccgaagucagaucguacugcuacgaagccagcaucagcgacauggccuccgacagccgcugcccaacccaaggggaagccuaccuagacaaacaauccgacacacaauacguaugcaaaaggacccuaguagauagaggguggggaaacggauguggucucuucggcaaaggcucccucguaacaugcgccaaauucacaugcagcaaaaagaugacaggcaagucaauacagccagaaaaccucgaguacagaaucaugcucucaguccacgguucacaacacagcggaaugaucggcuacgaaacggaugaagacagagcaaaaguggaaguaacaccuaacagcccacgcgcagaagcgacacuaggaggauucgggagucuaggauuggacugcgaaccaagaacaggccuagacuucagcgaccucuacuaccucacaaugaacaacaaacacuggcuaguccacaaggaaugguuccacgacauaccacuaccauggcacgcgggcgccgacaccggaacaccgcacuggaacaacaaagaagcccucgucgaguucaaagacgcgcacgcaaaacgacaaacgguaguaguccugggcucacaggaaggcgcaguacacacagcgcuagccggagcccuagaggcagaaauggacggcgcaaaaggccgccuguucagcggacaccuaaaaugcagacucaaaauggacaaacuacgccuaaaaggcgugucauacagccucugcacggccgccuuuacguucacaaaagugccagcagaaacacugcacggcacaguuacaguagaaguacaguaugccggaaccgacggcccaugcaaaaucccugugcagauggccguggacaugcaaacacugacaccgguaggacgacuaauaaccgcaaauccagugauaacggaaucaacagaaaacuccaaaaugaugcuggaacucgacccaccauucggcgacagcuacaucgugauaggcguaggagacaagaaaauaacacaccacuggcaccggaguggaagcacgcugggaaaagcauucagcacaacgcucaaaggcgcccagagacucgcggcacucggcgacaccgcaugggacuucggcucaaucggcggggucuuuaacagcaucggacgcgcagugcaccaagucuucggaggcgcguucagaacccucuucggaggcauguccuggauaacccaaggccucaugggcgcacugcuacuauggaugggggucaacgcgagagacagaagcauagccuuagccuuccuggccaccggaggaguacugguauuccuagcaacaaacgugcacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10624 - RNA, 2467 nt, Artificial Sequence
  ZIKV (strain NatalRGN) prME-short variant mRNA Design 2 opt
ggggcgcugccuacggagguggcagccaucuccuucucggcaucaagcuuaccaugggaaaacggagcgcaggcuccauaauguggcuagcaagccuagccgucgugaucgcgugugcaggcgccgucacccggagaggcucggcguacuacauguaccucgaccgaaacgacgcaggagaggcaaucucauuccccacaacacucggaaugaacaaauguuacauccaaauaauggaccuaggccacaugugcgacgcaacaaugagcuacgagugcccaaugcucgacgagggaguagaaccagacgacgucgauugcuggugcaacacaaccagcaccugggucgucuacggaaccugccaccacaagaaaggcgaagcacgccgaagcaggcgcgcagucacucuaccgagucauagcacgcgcaaacuccaaacacgcagccaaaccuggcucgagagcagagaauacacaaagcaccucauccggguagagaacuggaucuucaggaacccaggguucgcccuagccgcagcagcaauagcauggcuccuuggaagcagcaccucacagaaaguaauauaccuaguaaugauucuccucaucgccccagcguacagcauaagaugcaucggagucuccaauagagacuucguagaaggcaugucaggaggcacauggguagacguaguccuagaacacggcggaugcgugaccguaauggcacaagacaaaccaacgguggauauagagcuggucacaaccacaguaagcaacauggcggaaguccggagcuacugcuacgaggcaucaaucagcgacauggcaagcgacagucgaugccccacccaaggcgaagccuaccucgacaaacaaagcgacacgcaauacguaugcaaacgcacacucgucgacaggggguggggaaacggcugcggacucuucggcaaaggcucacucguuaccugcgcaaaauucgcgugcuccaagaaaaugaccggcaaguccauccaaccugaaaaccuggaauaccgaaucaugcuaucgguccacggcagccaacacagcggaaugauagugaacgauacaggucacgaaacagacgagaacagagcaaaaguagaaauaacuccaaacucaccgcgagcagaagccacccugggcggcuucggaagccuaggccucgacugcgaaccccgcaccgggcuagacuuuagcgauuuguacuaccucaccaugaacaacaaacacuggcucguccacaaagaaugguuccacgacauaccccucccauggcacgcgggcgcagacaccggaaccccacacuggaacaacaaagaagccuuaguagaguucaaagacgcacacgcaaagcgacaaaccguagucgugcucggcucccaagaaggagccguacacaccgcacucgccggggcacuggaagcagaaauggacggcgcaaaaggaagacucucaucaggacaccuuaaaugccgacucaaaauggacaaacuaagauuaaagggagucagcuacagucucugcacggcggccuuuaccuucacaaaaauccccgccgaaacacuacacggaacagucaccguggaaguacaauacgcgggaacagauggaccaugcaaagugccagcccaaauggcagucgauaugcaaacccuaacccccguaggacgauugauaacagccaacccagugauaacagaaagcaccgaaaacagcaaaaugaugcuagaacuagaucccccauucggagacagcuacauagucaucgggguaggagaaaagaaaauaacccaccacuggcaccgaagcggcagcacacugggcaaagccuuuucuacgacgcucaaaggagcacaacgacucgcagcucucggagacacagccugggacuucggcaguauaggaggcguauucaacucgauagggagagcaguccaccaaguauucggaggagcauucagaacacuguucggaggcaugagcuggauaacacaaggacuuaugggcgcacuccuacuguggaugggagucaacgcuagagacagaucaauagcccuagccuucuuggccaccggcggaguacucguauuccuugcaacaaacgugcacgcgugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10625 - RNA, 2170 nt, Artificial Sequence
  ZIKV (strain ZikaSPH2015) ME variant mRNA Design 2 opt
ggggcgcugccuacggagguggcagccaucuccuucucggcaucaagcuuaccaugacauccgugggaauagucggacuauuacucaccaccgcaauggccgcagucacccucccaagucacucuacccgcaaacuccaaacccgaucgcagaccuggcucgaaagccgcgaauacacaaaacaccucauccgagucgaaaacuggaucuuccgaaacccaggauucgcccucgccgccgccgcaaucgccuggcuccucgggagcucuacaucacaaaaagucauauaccucguaaugauacuacucauagcccccgccuauuccauccgcuguauaggaguaucaaaccgagacuucguagaaggcaugagcggcggcaccuggguagacaucguacucgaacacggaggcugcguaaccgucauggcacaagacaaacccaccguagacauagaacucgucacaacaaccguaucaaacauggcggaaguccgcuccuacugcuacgaagccucaaucagcgacauggccuccgacucacgcugcccaacacagggcgaggccuaccuagacaaacaaagcgacacccaauacguaugcaaacgcacacucgucgaccgaggcuggggaaacggcugcggccucuucggaaaaggaagccucguaaccugcgccaaauucgccugcuccaagaaaaugacuggaaaauccauacaaccggaaaaccucgaauacagaaucaugcucagcguccacggcucacaacacagcggcaugaucgugaacgacaccggacacgaaaccgacgaaaaccgcgcaaaaguagaaauaacuccaaacucaccacgcgcugaggccacacuaggcggcuucggcucccuagggcucgacugcgaaccaagaaccggucucgacuucucagaccucuacuaccucacaaugaacaacaaacacuggcuuguccacaaagaaugguuccacgacauaccccuccccuggcacgccggcgccgacacaggcacaccccauuggaacaacaaagaagcccucguggaguucaaagacgcgcacgcaaaacggcaaaccguaguagugcuagggucccaagaaggagccguccacacggcccucgcuggagcccucgaagcagaaauggacggcgcuaaaggccgacuguccucaggacaccucaaaugccgccucaaaauggacaaacuacgccucaaagguguuuccuacucacuaugcaccgccgccuucacguucaccaaaaucccagccgaaacccuccacggaacagucaccgucgaagugcaauacgccggcaccgacggccccugcaaagucccagcccaaauggcaguggacaugcaaacccuaaccccagucggccgccuaauuaccgccaaccccgucaucaccgaauccacagaaaacagcaaaaugaugcucgaacucgacccacccuucggcgacucguacaucgugauaggcgucggagaaaagaaaaucacacaccacuggcaccgcagcggcucaacaauaggcaaagcguucgaagccaccguccgcggcgccaaacgcauggccgugcucggcgacacagccugggacuucggauccgucgguggugcccuaaauagcuugggcaagggaauccaccaaaucuucggagccgccuucaaaagccuuuucggagggauguccugguucucccagauccucauaggaacccuacuaauguggcuaggccuaaacacgaagaacggcucaauaagccucaugugccucgcacuaggcggaguacuaaucuuccugucgacugccguauccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10626 - RNA, 2170 nt, Artificial Sequence
  ZIKV (isolate Z1106033) ME variant mRNA Design 2 opt
ggggcgcugccuacggagguggcagccaucuccuucucggcaucaagcuuaccaugaccagcgucggaauagucggccuccuccucacgacagcgauggcagccgugacacuccccucccacucgacaagaaaacuacaaacacgcucccaaacguggcucgaauccagagaguacacuaaacaccugauccgugucgaaaacuggauauuccgcaacccaggcuucgcccuggcagccgccgcaaucgccuggcuacucggcagcagcaccucacaaaaagucaucuaucuaguaaugauacuccugaucgcgccagcuuacuccauccgcugcauaggaguauccaacagagacuucgucgaaggcaugagcggaggcacaugggucgacgucguccuagaacacggaggaugcgucaccguaauggcacaagauaaacccacggucgacaucgagcuaguuaccacaacagucagcaacauggccgaaguccgcaguuacugcuacgaagccagcauaagcgacauggccucagacagcagaugcccaacccaaggcgaagccuaccucgacaaacagucagacacgcaauacguaugcaaaagaacccucguagaucgaggcuggggcaacggauguggacucuucgggaaaggcagccucguaaccugcgccaaauucgcgugcaguaagaaaaugacaggcaaauccauccaaccagaaaaccucgaauaccguauuaugcucuccguccacggcagccagcacuccggcaugaucguaaacgacaccggacacgagaccgacgaaaaccgagccaaagucgaaaucacccccaacucaccccgcgcagaagccacacucggcggcuucggcucccucggacuggacugcgaaccaaggacaggccuagacuucucagaccuauacuaccucacaaugaacaacaaacacuggcucgugcacaaagaaugguuccacgacaucccccuccccuggcacgccggagcagacaccggaacaccccacuggaacaacaaagaggcccuuguagaguucaaagaugcacacgccaagcgccaaaccguaguuguacugggaagccaagaaggcgcaguacacaccgcacuagcaggagcacuagaagccgaaauggacggcgccaaaggccgccuauccagcggccaccuaaaaugccgccucaaaauggacaagcucaggcugaaaggcgucagcuacucccucugcaccgcagcauucaccuucaccaaaauaccugcagaaacccuccacggcaccgucaccgucgaaguacaauacgcaggcacggacggcccaugcaaaguacccgcccaaauggccguggacaugcaaacccucacaccaguaggccgacucaucacagccaauccaguaaucacggaaagcacagaaaacaguaaaaugaugcuagaacucgacccacccuucggagacucuuacaucgucauaggaguaggcgaaaagaaaaucacccaccacuggcaucgcuccggcucaaccaucggcaaagcauucgaagccaccguacgcggcgccaaacguauggcuguccuaggagacaccgcaugggacuucggaucggucggcggcgcccucaacagccuaggaaaaggcauccaccaaaucuuuggagcggcguucaaaucccucuucggaggaaugucgugguucucccaaauacuaaucgguacgcuacuaauguggcucggccucaacgccaaaaacggaucaauuagccucaugugccuagcacuaggcggaguccuaaucuuccuaagcacagcgguaagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10627 - RNA, 2158 nt, Artificial Sequence
  ZIKV (strain MR 766) ME variant mRNA Design 2 opt
ggggcgcugccuacggagguggcagccaucuccuucucggcaucaagcuuaccaugaccuccaucggaauaauuggccuacuacucacaaccgcaauggcggccguaacccuucccucacacuccacucguaaacugcaaacccgcucccagacauggcucgaaucgagagaauacacaaaacaccuaaucaaagucgaaaacuggaucuuccgcaaccccggauucgcccuagucgccgucgcaaucgcauggcuccucggcuccucaaccagccaaaaaguuaucuaccucguaaugauccuccucaucgcacccgcauacucaauacgcugcaucggcgucucuaaccgcgacuuuguagaaggaaugucaggcggcaccugggucgacgucguacucgaacacgggggaugcgucaccgucauggcccaagacaaaccuacagucgacaucgagcuagucacgaccacagucucaaacauggcagagguaagaagcuacugcuacgaagccuccaucuccgauauggccuccgacucccgaugccccacacagggcgaagcauaccuagacaaacaauccgacacccaauacgucugcaaacgcacacucguagaccguggcugggggaacggcugcggacuauucggaaagggcucccucgucacaugcgcgaaauuuaccugcuccaagaaaaugaccggaaaaagcauacagcccgaaaaccucgaauaccgcaucaugcucuccgugcacggcagucaacacucaggcaugauaggcuacgaaacagaugaagaccgcgcaaaggucgaagucaccccaaacucccccagagccgaagccacccucgggggcuucggcagccucggacuagacugcgaaccuagaaccggccuagacuucagcgaccucuacuaccuaacgaugaacaacaaacacuggcuuguacauaaagaaugguuccacgacaucccccugcccuggcacgccggagccgacacaggaacaccgcacuggaacaacaaagaagcacucguugaguucaaagacgcccacgcaaaacgccaaacagucgucguacuaggaagccaagaaggcgccguccacaccgcacuagcaggagcauuagaagccgaaauggacggcgcaaaaggccgccucuucuccggccaccucaaaugccgacuaaaaauggauaaacuccgccucaaaggcgucagcuacucacucugcaccgccgccuucacauucaccaaaguccccgccgaaacacuacacggcaccguaacugucgagguacaauacgccggaacggacggcccuugcaagauacccguacaaauggcaguggacaugcaaacacucacccccgucggcagacuaauaacagccaacccgguaauaaccgaaagcaccgagaacucuaaaaugaugcuagaacucgacccacccuucggcgacagcuacaucgucaucggcgucggcgacaagaagaucacacaccacuggcacagaucagguuccacaaucggcaaggcauucgaagccacgguccgcggcgcaaaacgaauggccguccuaggcgauaccgccugggacuucggcuccgucggaggagucuucaacucccucggaaaaggaauccaccaaaucuuuggagccgccuucaaaucgcuauucggcggcaugagcugguucagccagauccuaauagguacacugcucguauggcucggcuuaaauaccaaaaacggaagcaucucccuaacgugccucgcccucggcggcgucaugaucuuccucuccacagccgugagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10628 - RNA, 2170 nt, Artificial Sequence
  ZIKV (strain NatalRGN) ME variant mRNA Design 2 opt
ggggcgcugccuacggagguggcagccaucuccuucucggcaucaagcuuaccaugacaagcguaggcauagucgggcuccuacuuacaacagccauggcagccguaacauuaccaucacacuccacccgcaaacuacagaccagaucccaaaccuggcucgaaagccgcgaauacacaaaacaccucauacgcgucgaaaacuggaucuucagaaaccccggguuugcccuagcagccgcagcaauagccuggcugcugggaagcuccacaucacaaaaggucaucuaccuaguaaugauccugcucauagccccagccuacuccauccgcugcauaggcgucagcaaccgcgacuucguagaagggaugucaggcgguacauggguagacgucguacucgaacacggaggaugcgucaccguaauggcgcaggacaaaccaacaguagacaucgaacucgucacaaccaccgucucgaacauggccgaagugcgaagcuacugcuaugaagcauccaucucagacauggcguccgacagccgaugccccacccaaggagaggcauaucucgacaaacaaagcgacacccaauaugugugcaaacgcacccucguggaccgcggauggggaaacggaugcggccuguucggaaaaggcucacucguaacaugcgcaaaauucgcaugcagcaagaaaaugaccggaaaaagcauacagccugaaaaccuagaauacagaauaaugcugagcguccacggcucacaacacuccggcaugauaguaaacgacacaggccacgaaaccgacgaaaacagagccaaaguagaaaucacaccaaauuccccacgagcagaagccacacucggcggcuucggcagccuaggccuagacugcgaaccacggacaggacuagacuucagcgaccucuacuaccucacaaugaacaacaaacacuggcugguccacaaagaaugguuccacgauauaccccuccccuggcacgccggagcagacaccggcaccccacacuggaacaacaaagaagcacuggucgaguucaaagacgcucacgcgaaacgccagacagucgucguacugggcagccaagaaggcgccguccacaccgcucucgccggcgcacuagaagcggaaauggacggggcaaaaggccggcuaucaagcggccaccugaaaugccgacucaaaauggacaaacuacgacugaagggcgucagcuacagucuaugcacagccgcauucaccuucacaaaaauccccgcagaaacccuacacggcacagucaccgucgaagugcaauacgccggcacagacggacccugcaaaguccccgcucagauggccgucgacaugcaaacauuaacccccgucggacgacuaauaaccgcaaacccaguaaucaccgaauccacagagaacuccaaaaugaugcucgaacucgaucccccauucggcgacagcuacauaguaaucggcguaggagaaaagaaaauaacgcaccacuggcaccgaagcggcuccaccauaggcaaagcauucgaagcgaccguccgcggagccaaacgcauggcagucuuaggcgacaccgcaugggacuucggcuccgucggcggcgcccuaaacagccucggaaaaggaauccaccaaaucuucggcgccgcauucaaaagccuauucgggggcaugucaugguucucccaaauccugauaggaacccuacucauguggcuagggcugaacaccaaaaacggcagcauaagccuaaugugccuagcacuaggcggaguccucauauuucucucaacagccgucucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10629 - RNA, 2197 nt, Artificial Sequence
  ZIKV (strain ZikaSPH2015) ME variant mRNA Design 2 opt
ggggcgcugccuacggagguggcagccaucuccuucucggcaucaagcuuaccauggccauaucaggcgucccuguccucggcuucuucaucaucgccguacuaauguccgcccaagagucaugggccgcagugacccucccaagccacagcacgcgcaaacuacaaacccgcagccagaccuggcucgaaagccgagaauacaccaaacaccuaauaagagucgagaacuggaucuuccgcaaccccggauucgcgcucgcggccgccgccaucgcauggcuccuaggcagcuccaccucacaaaaagucauauaccucgugaugauccuccuuaucgcccccgccuacuccauccgaugcaucggagucagcaaccgagacuucgucgaaggaaugucaggcggcacaugggucgacauaguccucgaacacggcggaugcgucaccguaauggcccaagacaaacccacagucgacaucgagcuagucacaaccacaguaucaaacauggcagaaguaagaagcuacugcuacgaagccuccaucucagacauggccucggacucacgaugccccacgcagggagaagccuaccuggacaaacagucugacacacaauacgucugcaaaagaacccucguagaccgcggauggggcaacggcugcggacuauucggaaagggcucccuaguaaccugcgcaaaauucgcaugcucgaagaaaaugaccggcaaaucaauucaacccgagaacuuagaauaccgcauaaugcucucaguacacggcucacaacauagcgggaugaucguuaacgacaccggccacgaaacagacgaaaaccgagcgaaagucgaaauaacaccaaacagcccacgcgcggaagccacccugggcggcuucgggucccucggcuuagacugcgaaccgcgaacaggacuagacuuuagugaccucuacuaccucaccaugaacaacaaacacugguuaguacauaaagaaugguuccacgacaucccacugcccuggcacgccggcgccgacaccggcacaccccacuggaacaauaaagaagcccucguagaguucaaagacgcccacgcgaaacgacaaacagucgucguacuaggcagccaagaaggcgcuguccacaccgcucucgccggagcacucgaagccgaaauggauggagcgaaaggacgacuaagcuccggccaccucaagugccgacucaaaauggacaagcuccgccugaaaggcgucaguuacucccuuugcacugcagcauuuaccuuuacgaaaauacccgccgaaacucuacacggaaccgucacaguagaaguccaauacgccggcacagacggaccaugcaaggucccagcccaaauggccgucgacaugcaaacacuuaccccaguaggaagacuaauaacagccaaucccguaaucacagaaucuaccgagaacucaaaaaugaugcucgagcucgaucccccauuuggcgacagcuacaucgucauaggggucggcgaaaagaaaaucacacaccacuggcaccgcagcggcagcacaauaggcaaagcauucgaagccacagucagaggcgcaaaacguauggcgguacugggcgacacagccugggacuucggaaguguaggcggagcacuaaacucguuaggcaaaggcauacaccaaauauucggagcagccuucaaaagccuguucggcggaaugucaugguucucgcaaauccuaaucggcacucuccucaugugguuaggccucaacaccaaaaacgggagcaucagccuaaugugccucgcacucggaggagugcucaucuuccuaagcacggcagucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10630 - RNA, 2197 nt, Artificial Sequence
  ZIKV (isolate Z1106033) ME variant mRNA Design 2 opt
ggggcgcugccuacggagguggcagccaucuccuucucggcaucaagcuuaccauggccaucagcggcguccccguacucggauucuucaucaucgccguacuaauguccgcccaagaaagcugggcagccgugaccuuaccaucacacucaacuagaaaacuccaaacacgcucccaaaccuggcucgaaucuagagaguacaccaaacaccucauccgaguagaaaacuggaucuuccgaaacccaggauucgcacuugccgcagccgcgaucgcauggcugcucggaagcucuaccucacaaaaaguaauauaccuagucaugauucuccuuaucgcccccgcauacagcauacgcugcaucggagucuccaacagagacuucgucgaaggcaugagcggcggcacauggguagacguaguccucgaacacggaggaugcgucaccguaauggcccaagacaaacccaccguagacauagaacuggucacaacaaccgucucaaacauggccgagguaaggagcuacugcuacgaagccuccaucuccgacauggcaagcgacagucgcugcccaacccaaggagaagccuaccuagacaagcaaagugacacccaauacguaugcaaacgaacccucgucgaccgaggauggggaaacgggugcggccuauucggaaaaggaagccucgucacgugcgcaaaauucgcaugcagcaagaaaaugacaggcaaaagcauccaacccgaaaaccucgaguacagaauaaugcuaagcgugcacggcucacaacacuccggcaugaucguaaacgacacaggacacgaaaccgacgagaaccgagccaaagucgaaaucacccccaacucaccacgcgccgaagcaacccucggcggauuugguucccucggacuagacugcgaaccaagaaccggacucgacuucuccgacuuauacuaccuaaccaugaacaacaaacacuggcuaguacauaaagaaugguuccacgacaucccacuacccuggcacgcgggcgcggacaccggcaccccacacuggaacaacaaagaagcacucguagaauuuaaagacgcacacgccaaacgccaaacagugguagugcuaggaucccaggaaggagccguccacaccgcacucgcaggggcccuugaagccgaaauggacggagcgaaaggccgccuuucgagcggacaccucaagugccgccuaaagauggacaaacuccgacucaagggaguaagcuacucccucugcacagcagcauucacauucacaaaaauacccgccgagacacuucacggcaccgucaccgucgaaguccaguaugccggaaccgacggacccugcaaaguaccagcucaaauggccguagacaugcaaacccuaacgcccgucggacgacuaauaacagcgaacccggucaucaccgaaucaaccgaaaacagcaaaaugaugcucgaacuagaucccccauucggagacagcuacauaguaaucggcguaggagaaaagaaaaucacgcaccacuggcaccgcucaggaucaaccauaggaaaagcguucgaagcaaccgugcgcggcgcuaaacgcauggcaguccucggcgacaccgccugggacuuuggaucagucggaggagcccucaacagccucggcaaaggcauacaccaaaucuucggagcagccuuuaaaucccucuucggaggcaugucgugguucagccaaauacuaaucgggacccuacuaauguggcuaggacucaacgccaaaaacggcagcauaucccucaugugccuagcccucggcggaguccucauauuucuaucaacagccgucucagcuugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10631 - RNA, 2185 nt, Artificial Sequence
  ZIKV (strain MR 766) ME variant mRNA Design 2 opt
ggggcgcugccuacggagguggcagccaucuccuucucggcaucaagcuuaccauggcgauauccggagucccaguccucggcuucuucaucaucgcaguccugaugucagcgcaagaaagcugggcagcggucacacuacccagccacuccacacgcaaacuccaaacacgcagccagacauggcuagaaucccgcgaauacacaaaacaccucaucaagguagaaaacuggaucuuccgaaaccccggauucgcgcucgucgcuguagcaaucgcauggcuacucggcagcucgacaucgcaaaaagucaucuaccuagucaugauccuacucaucgcacccgccuacuccauaagaugcaucggcgucuccaaccgagacuucguagaaggaaugucaggcggcaccugggucgacgucguccuagagcacggaggcugcguaaccgucauggcacaggacaaaccaacagucgacauagaacucguaacaaccaccguaucaaacauggccgaaguccguucauacuguuacgaagccucaauaagugacauggccucagacagccgaugccccacccagggggaggcauaccuggacaagcaaucagacacccaauacgucugcaaaagaacgcucguagaccgcggcugggguaacggcugcgggcuauucggcaaaggcucccucgucacgugcgccaaauucacgugcagcaagaaaaugaccggaaaaagcauccaaccugaaaaccucgaauaccgaauaaugcuguccguccacggcagccaacacagcggcaugaucggcuacgaaaccgacgaagaccgcgcaaaagucgaagucacacccaacucaccacgcgcggaagccacacugggaggauucggaagccuaggacuagacugcgaaccacgaacaggacucgacuucagcgaccuuuacuaccucaccaugaacaacaaacacugguuaguccacaaagaaugguuccacgacaucccccuccccuggcacgccggagccgacacaggaacgccccacuggaacaacaaagaagcccucgucgaguucaaagacgcgcacgcaaaaaggcaaaccgucgucguucuaggaucacaagaaggcgcgguacacaccgcgcuagccggcgcccuagaagccgaaauggacggugccaaaggucgccucuucucaggacaccucaaaugccggcugaaaauggacaaacuccgccuaaaaggcguauccuacagccucugcaccgcagccuucaccuucacaaaagucccugccgaaacccugcacggcaccgucaccgucgaaguccaauacgccggaacggauggccccuguaaaauccccguacaaauggccguagacaugcaaacccucacgcccguaggccgacucaucaccgccaacccagucauaacagaauccaccgaaaauagcaagaugaugcuagaacucgaucccccauucggagacucauacauagucaucggagucggcgacaaaaagauaacacaccacuggcaccgcucaggcucaaccaucggcaaagccuucgaagccaccguccgcggcgcaaaaagaauggcaguccucggagacaccgcaugggacuucggcuccguaggaggcguauucaauagccuaggcaagggcauucaccaaauauucggggcagccuucaagagcuuauucggcgggaugucaugguucucccaaauacucaucggaacacuccuaguguggcucggccucaacacaaagaacggcucaaucagccuuaccugccucgcacucggaggcgugaugauauuccuauccacagccguauccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10632 - RNA, 2197 nt, Artificial Sequence
  ZIKV (strain NatalRGN) ME variant mRNA Design 2 opt
ggggcgcugccuacggagguggcagccaucuccuucucggcaucaagcuuaccauggcaauauccggcgugcccguacucggauucuucaucaucgccguccucaugucagcgcaagaauccugggcagccguaacacuccccucccacagcacccgcaaacuacaaacaagaagccaaaccuggcuagaaucacgagaauacaccaagcaccuuauaagagucgaaaacuggauauuccgaaacccaggauucgcacuggcggccgcagcaauagcauggcuccuaggcucgaguacaagccaaaaaguaaucuaccucguaaugauccuacuaaucgcacccgcguacucaaucagaugcaucggcgucagcaacagagacuucguagaaggaauguccggagggacuugggucgacguaguacuagaacacggcggcugcgucacaguaauggcacaagacaaaccaaccgucgacauagagcuagugaccacaaccgucagcaacauggcggaaguacgcagcuacugcuacgaagcaagcauaucggacauggcaagcgacagccgcugcccaacacagggcgaagcauaccuagacaaacaauccgacacccaauacguuugcaagcgaacacucgucgaccgcggcuggggcaacggcugcggccuauucggcaaaggcucccuaguaacaugcgcaaaauucgcaugcucuaagaagaugacaggcaagagcauacaaccagaaaaccucgaauacaggaucaugcuaucgguccacgguucacaacauucaggcaugaucgucaaugacacgggacacgaaaccgacgaaaaccgcgccaagguggaaauaacgcccaacaguccccgcgccgaggcaacccugggcgguuucggcagccucggccucgacugcgaaccaagaaccggacucgacuucagcgaccuauacuaccuaacuaugaacaacaagcacuggcuuguccacaaagagugguuccacgacauaccccuccccuggcacgcaggagcagacaccggaaccccacacuggaacaacaaagaagcacucguagaguucaaagacgcccacgcgaaaagacaaacagucgugguacuggggagccaagaaggugccguccacacagcccuagccggagcacucgaagcagaaauggacggcgcaaaagggcgccucucaucaggccaccuaaagugccgacuaaaaauggacaaacuccgccuaaaaggcguaucuuacucccuaugcaccgccgcauucaccuuuacaaagauaccggccgaaacccuccacggcaccguaacaguagaaguccaauacgccggcaccgacggccccugcaaaguccccgcccaaauggcaguagacaugcaaacacuaacacccgucggccgacucauaaccgccaaccccgucauaacagaaaguacugaaaacuccaaaaugaugcucgaacucgacccacccuucggagacagcuacauagucauaggcgucggcgagaaaaagauaacccaccacuggcaccgcuccggcuccacaauaggcaaggccuucgaagccaccguaagaggcgcaaaacgcauggcaguccugggagacacagcaugggacuucggcuccguuggaggggcacuaaacucacuagggaaaggcauacaucaaauuuucggcgcagccuucaaaagccuauucggcggaaugagcugguucagccaaauacuaaucggcacacuacuuauguggcucggccucaacacgaaaaacggaagcaucucccuaaugugccuagcacucggcggcgugcuaauauuccuaagcacagcagucagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10633 - RNA, 2176 nt, Artificial Sequence
  ZIKV (strain ZikaSPH2015) ME variant mRNA Design 2 opt
ggggcgcugccuacggagguggcagccaucuccuucucggcaucaagcuuaccauggacuggacauggauacuauuccucguagcagcagcgacaagagugcacagugcaguaacccuccccucacacagcacgagaaaacuacagacgcgcagccaaaccuggcucgaaucacgagaauacaccaaacaccuaauacgagucgagaacuggauauucagaaaccccggcuucgcccuagcagcagcagcaaucgccuggcuccuaggcagcagcacaucacaaaaagugauauaccugguaaugauccuucuuauagcccccgccuauaguauaagaugcaucggcgucagcaaucgcgacuucgucgaaggaaugucgggaggaaccugggucgacauaguucuagagcacggaggcugcgucaccguaauggcacaagacaaaccaacaguggacaucgaauuaguuaccacaacgguaagcaacauggccgaagucagaagcuauugcuacgaagcaagcauaucagacauggcaagcgacucccgaugccccacccaaggcgaggcuuaccuagacaaacagagugacacccaguacgugugcaaaagaacccuagucgaccguggcuggggcaacggaugcggacucuucggcaaagggagccucguaacaugcgcaaaauucgcuugcucaaagaaaaugaccggcaaaagcauccaaccagaaaaccuagaauaccgaaucaugcucuccguacacggaucacaacacagcggaaugauagugaacgacaccgggcacgagacagacgagaaccgcgccaaaguagaaauaacccccaacagucccagagccgaagcgacacuaggaggauucggaucauuagggcuggacugcgagccacgaaccggccuagacuucucagaccuauacuaccucacgaugaacaacaaacacuggcucguacacaaggaaugguuccacgacauaccccuaccauggcacgccggcgcagacacaggcacaccccacuggaacaauaaagaagcccucgucgaauuuaaagacgcccacgccaaacgccaaacaguggugguacucggcucacaagaaggugccguucacacggcccuagcaggcgcccuggaagccgaaauggacggagccaaaggucgacuaagcagcggacaucuaaaaugcagacugaaaauggacaaacuccggcucaaaggaguaucauacagccuaugcaccgccgccuucacguucacaaaaauaccagcagagacccuccacggcacagucacgguagaaguccaauacgccggcaccgacggccccugcaaagugccagcacaaauggcagucgacaugcaaacccugacacccgucggcaggcuaaucaccgcaaaccccgucaucacagagaguacagagaacagcaaaaugaugcucgaacucgacccacccuucggagacucguacaucgucauaggcgucggcgaaaagaaaaucacccaucacuggcauagaagcggaagcaccauaggcaaagccuucgaagccaccguacgcggggccaaacgcauggccguccucggagacacagcgugggacuucggcucgguaggcggcgcacucaacucacucggcaaaggcauacaccaaaucuucggcgcagccuucaaaucccuauucggcgggaugagcugguucucgcaaauacuaauaggcacccugcuaauguggcucggacuaaacaccaaaaacggcucgaucucauuaaugugccuagcgcucggcggaguacuaaucuuccuaucaacagcaguaucagccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10634 - RNA, 2176 nt, Artificial Sequence
  ZIKV (isolate Z1106033) ME variant mRNA Design 2 opt
ggggcgcugccuacggagguggcagccaucuccuucucggcaucaagcuuaccauggacuggaccuggauccucuuccucguagccgccgccacacgcguacacagcgcagucacacucccgagccacagcaccagaaaguuacaaacacgcucucaaacguggcuagagucccgagaauacacaaaacaccuaauacgcguagaaaacuggaucuucagaaacccagguuucgcccuggcggcagccgccaucgcguggcuacucggcucaagcaccagccaaaaagucaucuaccucgucaugauccuacucauagccccagccuacuccauccgaugcaucggagucuccaauagagacuucguggagggaaugagcggcgguaccugggucgacguuguccuagaacacggcggcugcgucaccguuauggcccaagacaaacccaccgucgacauagaauuagucaccacaacagucucaaacauggccgaaguccgaagcuacuguuacgaagccuccaucuccgacauggccagcgacucacggugcccgacccaaggcgaggcuuaccucgacaaacaaucagacacacaauacgucugcaaacgcacacucgucgacagaggcuggggcaacggcugcggccuguucggcaaaggcucccuaguuaccugcgcuaaauucgcaugcagcaagaaaaugaccggcaaaagcauccagcccgaaaaccuagaauacagaaucaugcucucaguccacggaagccaacacagcggcaugauagucaacgacaccggccacgaaaccgacgaaaacagagccaaagucgaaaucacccccaacucaccccgcgcggaggccacacuuggcggauucggcucccuaggacuggacugcgaaccccgcaccgggcuagacuucuccgaccuauacuaccucacaaugaacaacaaacacuggcuaguccacaaagaaugguuccacgacauaccauuacccuggcaugccggcgcagacacaggaacaccccacuggaacaacaaagaagcacucgucgaguucaaagacgcccacgccaaacgccaaaccgucgucgugcuaggaucccaagaaggugccguacacaccgcccuugcaggggcucucgaagccgaaauggacggcgccaagggacgccuuuccuccggccaccugaaaugccggcucaaaauggacaaauuacgacucaaggguguaucauacucccucugcaccgcagcauucaccuucaccaaaauccccgccgaaacgcuccauggcaccgucacagucgaaguucaauacgccggcaccgacggacccugcaaggugccggcgcaaauggccgucgacaugcaaacccuaacgcccguagggaggcucaucacugccaacccaguaauaacagaaagcacagaaaacuccaaaaugaugcucgaacucgacccgcccuucggggacucauacauaguaauuggcguaggcgaaaagaaaauaacacaccacuggcacagaagcggaucaacaauaggaaaagccuucgaagcaacgguaagaggggccaaaagaauggccguacucggagacaccgccugggacuucggcucaguugggggugcacuaaacucccucggcaaagguauccaccaaauauucggcgcugcauucaaaucacucuucggaggaaugucaugguucucccagauacucauaggcacccugcucauguggcucggccucaacgcgaaaaacgguagcauuucacuaaugugccucgcauuaggcggagugcucauauuccuaucaaccgcagucagcgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10635 - RNA, 2164 nt, Artificial Sequence
  ZIKV (strain MR 766) ME variant mRNA Design 2 opt
ggggcgcugccuacggagguggcagccaucuccuucucggcaucaagcuuaccauggauuggaccuggauacucuuccuagucgcagcagcaaccagaguacacucagccguuacccuccccagccacucaacaagaaagcugcaaacacgcagccaaacguggcuagaaucccgcgaauacacgaaacaccucauaaaggucgaaaacuggaucuucagaaacccaggcuucgcgcucgucgcggucgccaucgcauggcuacucggguccagcacuucccaaaaagucauauaccuagucaugauccuacucaucgcacccgcuuacagcauccgcugcaucggaguauccaaucgagacuucguagaaggcaugagcggaggcacauggguagacguaguccucgaacacggcggaugcgucaccguaauggcgcaagacaaacccaccguagacaucgaacucguaacaacaaccgucucgaacauggcagaagucagaagcuacugcuacgaagcaagcauaagcgacauggcgagcgacucccgcugccccacccaaggggaagccuaccuggacaaacaaagcgacacccaauacguaugcaaacgaacacucguagauagaggcuggggcaacggaugcggccuauucggaaagggaucccuagucacaugcgcaaaauucacaugcucaaagaaaaugacaggcaaaucaauacaacccgaaaaccucgaauaccgcaucaugcucagcguccacggaucacaacacucgggaaugauaggauacgaaacggacgaagaccgggcaaaaguagaggucacaccaaacuccccaagggcggaagccacccucggcgguuucggcucacuggggcuagacugcgaaccccgcaccggacucgauuucucagaccuauacuaccucacaaugaacaacaaacacuggcucgugcacaaggaaugguuccacgacauaccccucccguggcacgccggcgcggacacaggaacaccccacuggaacaauaaagaagcacucgucgaguucaaagacgcacacgccaaacgccagaccguaguaguacucggaucacaagaaggggccguacacacggcgcuggccggagcacuagaagcagaaauggauggcgcaaaaggccggcuauucaguggacaccuaaaaugucgccuaaaaauggacaaacucagacucaaaggagucuccuacucccuaugcacggccgcguucacauucacaaaaguccccgcagaaacacuccacggcacgguuacagucgaaguccaauacgcaggcaccgacggccccuguaaaauaccuguacaaauggccgucgacaugcaaacacucacacccgucggaagacugaucacugcaaacccagucauaacagaaaguacagaaaacagcaaaaugaugcuagaacuugacccacccuucggcgauucguacaucgucaucggcguaggagacaagaaaaucacccaccacuggcaccgaagcggcagcaccauaggaaaagcauucgaagcaacaguacgcggagccaaaagaauggccguccuuggagacacagccugggacuucggguccgucggaggcguauucaacagccugggaaaaggcauccaccagaucuucggcgcagcauucaaaucgcuauucgguggaauguccugguucagccaaauccuaaucgggacccucuuaguguggcuaggacuaaacacgaaaaacggcagcaucagccuaaccugccuagcccugggaggggucaugaucuuccucucaacugcagucucagcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10636 - RNA, 2176 nt, Artificial Sequence
  ZIKV (strain NatalRGN) ME variant mRNA Design 2 opt
ggggcgcugccuacggagguggcagccaucuccuucucggcaucaagcuuaccauggacuggacguggauacucuuccucguagcagcggccacaagaguccacagcgcaguaacacugcccucacacucuacccgcaaacugcaaacacgcagccaaacauggcuagaaucacgcgaguacacaaaacaccugauccgagucgaaaacuggauauucagaaacccaggauucgcccuggcagcggccgccauagccuggcuacucggaagcucuaccucacaaaagguaauauaccuaguaaugauccuccucaucgcccccgccuacucaauacgcugcaucggaguaagcaaccgcgacuucgucgaaggaaugagcggaggaaccuggguggacgucgucuuagagcacggaggaugugucacgguaauggcccaagacaaacccaccgucgacauagaguuggucaccacaacagucuccaacauggccgaggucagaagcuacuguuacgaagcaaguaucucagacauggccagcgacagccgcugcccaacacaaggagaagcauaccucgacaagcaaagugacacacaauacgugugcaagcgcacgcuaguagaccgaggcuggggaaacggcugcggccucuucggaaaaggcagccucguaacaugcgccaaauucgccugcuccaaaaagaugaccggcaagucgauccaacccgaaaaccucgaauacagaaucaugcuauccguacacggaagccaacacucaggcaugauagucaacgacacuggacacgaaaccgacgaaaaccgcgccaaaguagaaaucacaccaaacucaccacgagcagaagcaaccuuaggaggauucggcucccuaggacucgauugcgagcccagaacagggcuggacuucucagaccuauacuaccuaacaaugaacaacaaacacuggcuaguacacaaagaaugguuucacgacauaccacuaccauggcacgcuggugcagacacgggaacgccccacuggaacaacaaagaagcacucguagaguucaaagacgcacacgcaaagagacaaacaguugucguccuaggaagccaagaaggcgccguacacacggcccucgccggagcucucgaagccgaaauggacggagcuaagggaagacucagcagcggccaccuaaaaugccgacuaaaaauggacaaacuccgacucaagggaguaagcuacucacuaugcacggccgccuucacauucacaaaaauacccgccgagacccuccacggaaccgucaccgucgagguacaguacgcaggaaccgacggacccugcaaaguacccgcgcagauggcaguagacaugcaaacacucacccccgugggacgccucauaaccgcgaacccagucauaaccgaguccacggaaaacagcaaaaugaugcuagaacuugacccaccauucggagacuccuacaucguaauaggcgucggcgaaaagaaaaucacacaccacuggcaccgaucaggcucgaccaucggaaaagccuucgaagcaacaguacgcggcgccaaacgcauggcaguccucggagacacggccugggacuucggcucaguagggggcgcacucaacagucuaggaaaaggcauacaccagaucuuuggggcagccuucaaaagccuauucggcggaaugagcugguucagccaaaucuuaaucggaacacuacuaauguggcucggccuaaacaccaaaaacggauccaucagccuuaugugccuugccuuaggaggcgugcuaauauuccugagcacagcuguaagcgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10637 - RNA, 2194 nt, Artificial Sequence
  ZIKV (strain ZikaSPH2015) ME variant mRNA Design 2 opt
ggggcgcugccuacggagguggcagccaucuccuucucggcaucaagcuuaccauggguaaaagauccgccggcagcauaauguggcuggccucccucgccgucgugauagcaugcgcaggcgccgcagucacacuccccagccacagcaccagaaaacuacaaacccgcucccaaaccuggcuagaaucaagagaauauacaaaacaccucauaagagucgaaaacuggauauuccgaaaccccggcuucgcacucgccgccgcagcaauagccuggcuccucggcucuagcacgucacaaaaggucauauaucuagucaugaucuugcuaaucgccccagcauacuccauccggugcauaggcguuuccaaucgggacuucguagaaggcauguccggcggaaccugggucgauauaguccuagaacauggcggaugcgucacagucauggcacaagacaaacccaccguagacauagagcuagucaccacgaccgugagcaacauggccgaagucagaucauacugcuacgaagcaucaaucucggacauggcauccgacagccgcugucccacacagggagaagccuaccuagacaaacaauccgacacacaauacgucugcaaacgaacccuaguagaccgcgguuggggaaacggaugcggccucuucggcaaaggaagccuggucacaugcgcaaaauucgccugcagcaagaagaugaccggcaaaagcauccaaccugaaaaccucgaauaccgcaucaugcuuuccguacacggcagucaacacuccggaaugaucgucaacgacacagggcacgaaaccgacgaaaaccgcgccaaagucgaaaucacacccaacagcccccgagccgaagccacccucggcggcuucggcucccucggacuagacugcgagcccaggacgggccucgacuucuccgaccuauacuaccucacaaugaacaacaaacacuggcuaguccacaaagaaugguuccacgacaucccccuccccuggcacgcaggcgccgacacaggcacaccacacuggaacaacaaggaagcacucguagaguucaaagacgcccacgcaaaacgccaaacaguaguaguacugggaucccaagaaggagccgugcacaccgcacuagcaggcgcacucgaagccgaaauggacggagcgaagggccgacuaucguccggacaccuuaaaugcaggcugaagauggacaaacucagacuaaaaggaguauccuacucccuaugcacagccgcauucacauucaccaaaauacccgcagaaacccuacacggaaccgucacagucgaaguccaauacgccggaaccgacggccccugcaaaguccccgcgcaaauggccguagacaugcaaacucucacccccguuggaagacucaucaccgccaacccggucaucacggaaaguaccgaaaacuccaaaaugaugcucgagcuagacccacccuucggagauuccuacauagucaucggcguaggagaaaagaaaauaacacaucacuggcacagauccggcuccaccauaggcaaagccuucgaagccaccguacgcggggcuaaacgcauggccguccucggcgacacagcaugggacuucggauccguaggcggagcccucaacucacugggcaaagggauucaccaaaucuucggcgccgccuucaaaagccuauucggcggaaugagcugguucucccaaauccuaauuggcacccuacuaauguggcucggccucaacacgaaaaacggcagcaucagccuuaugugcuuagcccucggaggcguccucaucuuccucuccacagccgucuccgcaugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10638 - RNA, 2194 nt, Artificial Sequence
  ZIKV (isolate Z1106033) ME variant mRNA Design 2 opt
ggggcgcugccuacggagguggcagccaucuccuucucggcaucaagcuuaccauggggaaacgaagcgcaggcuccaucauguggcucgccucacuagcagucgucauagcaugcgcaggcgcagccguaacccucccuucccacucaacaagaaaacuacaaaccagaucacaaacguggcuagaaucgcgagaauacacgaaacaccucaucagagucgaaaacuggauauuuaggaaccccggcuucgcccuagcagcagccgcaaucgcguggcugcugggcagcucaacaucgcaaaaagugauauaccuaguaaugauccuccuaauagccccggcauacagcauacgcugcaucggaguaucaaaccgagacuuugucgaggguauguccggcggaacauggguagacgugguucucgaacacggcggcugcguaaccguaauggcacaagacaaaccaaccguggacaucgaacucgucacaacaaccguaagcaacauggccgagguacgauccuacugcuacgaagccagcauuucagacauggcaagcgacuccagaugcccaacccagggcgaagccuaccucgacaaacaaagcgacacacaauacguaugcaaacgaacacucguggaccgaggcuggggaaacggcugcggacuguucggaaaaggaagccuagugaccugcgcgaaauucgccugcuccaagaaaaugacaggaaaaucaauccagccugaaaaccucgaguaccgaauaaugcucagcguccauggaagccagcacuccggcaugauaguaaacgacacaggacacgaaacggacgaaaacagagcaaaaguagaaaucaccccaaacucacccagagccgaagcaacacuuggaggcuucggcucacucggacuagacugcgagccacgcaccggacucgacuucagcgaccucuacuaccuaaccaugaacaacaaacacuggcuuguacacaaagaaugguuccacgacauaccccucccuuggcacgcaggagcagacaccggaacaccccacuggaacaacaaagaagcacugguagaguucaaagacgcacacgcaaaacgacaaaccguagucgugcugggcagucaagaaggcgccgugcacaccgcccucgcuggagcccuugaagcagaaauggacggggccaaaggcagacucucauccggccaccucaaaugccgacucaaaauggacaaacuuagacuaaaaggcguaagcuacagccugugcacggcggcauucacauucacgaaaauaccagccgagacccuacacggcacugucaccguagaaguacaguacgcaggcacagacgggcccugcaaaguacccgcacaaauggccguugacaugcaaacccuaaccccagucggccgccucaucaccgccaaccccguaauaacagaaagcacagaaaacagcaaaaugaugcucgaacucgacccaccguucggagacagcuacaucguaaucggcgugggcgaaaagaaaauaacgcaucacuggcaccgaucaggaucaaccaucggcaaagccuucgaagcaaccguucgcggcgcaaaaagaauggccguacuaggcgacacggcaugggauuucgguagcguagggggcgcccuaaacucccuaggcaaaggcauccaccaaaucuucggcgccgcauucaaaucacuauucggcggaaugagcugguucagccaaauccucaucggcacccuccucaugugguuaggacugaaugccaaaaacggaagcaucucacucaugugccuagcccugggaggaguauuaaucuuccuaucuacagcaguaucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10639 - RNA, 2182 nt, Artificial Sequence
  ZIKV (strain MR 766) ME variant mRNA Design 2 opt
ggggcgcugccuacggagguggcagccaucuccuucucggcaucaagcuuaccaugggcaaaagaucagccggaucaaucauguggcuugcaagccucgcuguaguaaucgccugcgcuggagcagcagucacccuccccucacacuccaccagaaaacuacaaacacgcucccaaacauggcucgaaucacgagaauacaccaaacaccucaucaaggucgaaaacuggaucuuccgaaaccccggauucgcacucguagcaguagccaucgcauggcuacucggauccucaaccagccagaaaguaauauaccuagucaugauccuccugauagcacccgccuacagcauccgaugcaucggcgucagcaaccgagacuucgucgaaggcaugucagggggaaccugggucgacgucguccuagagcacggcggcugcguaacagucauggcacaagacaagcccaccgucgacauagaacuggucacaacuaccguauccaacauggccgagguaagauccuacugcuacgaagccagcauaagcgacauggccagcgacaguaggugcccuacacaaggcgaagccuaccucgauaaacaaucagacacccaauaugucuguaaacgcacucuaguagacagaggauggggcaacggcugcggccuauuuggcaaaggcagccuagucacaugcgcaaaguuuaccugcagcaagaaaaugaccggaaaaucaauccaaccagaaaaccucgaauaccgaaucaugcucucaguacacggaucgcaacacucaggcaugaucggcuaugaaaccgacgaagaccgugccaaaguagaaguaaccccaaacagcccacgagcugaagcaacccuaggaggcuucggaucccucgggcucgacugcgaaccaagaaccggccuagacuucuccgaccuguacuaccucacgaugaacaacaaacacuggcucguacacaaggaaugguuccacgacauaccgcuacccuggcacgcaggcgcagacacaggcacgccacacuggaacaacaaagaagcccuaguggaguucaaagacgcacacgcaaaacgccagaccguggucguccuagggagccaagaaggagccguacacacagcccuggccggcgcccuugaagccgaaauggacggcgcaaaaggccgacucuucagcggacaccucaaaugccgucucaaaauggacaaacuacggcucaaaggcguauccuauucacucugcaccgccgccuucacauucacaaaggucccugcggaaacucuacacggaacagucacagucgaagugcaauacgcaggaaccgacggcccuugcaagauaccaguccagauggccgucgacaugcaaacccucacgccagucggccgacucaucaccgcaaaccccguaaucacagaaucaacggaaaacucaaagaugaugcucgagcucgacccucccuucggagacucauacauagucaucggggucggcgacaagaaaauaacccaccacuggcacagaagcggcuccaccaucggaaaagccuucgaagcgacaguccgaggcgcaaaacgcauggccguacucggagacaccgcgugggacuuuggcucaguaggcggcguguuuaacagccucggaaaaggaauccaccaaauauucggagcagcguucaaaucacuguucggcgggauguccugguucucccaaauccucaucggaacacuucucguauggcuaggccuaaacaccaaaaacggaucaaucucacuaacaugccucgcccucggaggagucaugauauuccugucgacugcggucucggccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10640 - RNA, 2194 nt, Artificial Sequence
  ZIKV (strain NatalRGN) ME variant mRNA Design 2 opt
ggggcgcugccuacggagguggcagccaucuccuucucggcaucaagcuuaccaugggaaagcgauccgcaggauccauaauguggcucgccucccuagccgucguaauagcgugcgccggcgcagccguaacccuacccucccacagcacccgcaagcuacaaacacgcucacaaaccuggcuugaaucacgcgaguacacuaaacaccuaauacgcguagaaaacuggaucuuccguaaccccggguucgcacucgccgcagccgccaucgccuggcuucuaggaagcuccacaucacaaaaagucaucuaccuagucaugauccuccucauugccccagccuacaguaucagaugcaucggugucuccaaccgggacuucgucgaagggauguccggaggaacauggguagacgucguccucgaacacggcggcugcguaaccguaauggcgcaggacaaaccgacugucgacauagagcuaguaaccacuaccgucuccaacauggcagaaguacgauccuacugcuacgaagccagcauuagcgacauggcauccgacagccgcugccccacccaaggcgaagccuaccucgacaaacaaucagacacccaauacgucugcaaacgcacacucgucgaccguggcuggggcaacggcugcggacucuucggaaagggcucccuaguuaccugcgcaaaguucgccuguuccaagaaaaugaccggcaaaucgauacaaccagaaaaccucgaauaucgaauaaugcucuccguccacggcagccaacacagcggcaugauaguaaacgacaccggacacgaaacagacgaaaaccgcgcuaaagucgaaauaacacccaacucaccccgggccgaagccacccucggcggcuucggaucacucggccucgacugcgagcccagaaccggccuagacuucucggaccucuacuaucuaacaaugaacaacaaacacuggcucguccacaaagaaugguuccacgacaucccacuccccuggcacgccggagccgacaccggaacaccucacuggaacaacaaagaagcccucgucgaguucaaagacgcccacgccaaacgccagacagugguaguacuaggcagccaagaaggagccguccacacggcccuagcaggagcccuggaagccgaaauggacggagcaaaaggcagacucucuagcggccaccucaagugccgccuaaaaauggacaaacuacgacuaaaaggcguuuccuacagccugugcaccgccgccuucacguucacuaaaauacccgccgaaacccuccacggcaccguaacagucgaaguccaauacgcaggaaccgacggaccgugcaaaguaccugcacaaauggccguagacaugcagacccugaccccaguaggcagacuaaucacagccaaccccguaauaacggaaucaaccgaaaacucaaaaaugaugcuugaacuagacccgcccuucggggacaguuacaucguaaucggcgucggagaaaagaaaauaacccaccacuggcacagauccggaucaaccaucggaaaggccuucgaagcaaccguccggggagccaaacgcauggccguccuaggagacacagccugggacuucggcagugucggcggcgcccucaacagucugggaaaaggcauacaccaaaucuucggcgcagcauucaagagccuauucgggggaaugagcugguucucccaaauacuaauaggaacccuccuaauguggcugggacucaacaccaaaaacggcagcaucucacucaugugccucgcccucggcggaguacugauauuccucucuacagcagucuccgccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10641 - RNA, 2311 nt, Artificial Sequence
  ZIKV (strain ZikaSPH2015) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10642 - RNA, 2311 nt, Artificial Sequence
  ZIKV (isolate Z1106033) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10643 - RNA, 2299 nt, Artificial Sequence
  ZIKV (strain MR 766) prME-short variant mRNA Design 3 wild type
gggagaaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10644 - RNA, 2311 nt, Artificial Sequence
  ZIKV (strain NatalRGN) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10645 - RNA, 2290 nt, Artificial Sequence
  ZIKV (strain ZikaSPH2015) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10646 - RNA, 2290 nt, Artificial Sequence
  ZIKV (isolate Z1106033) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10647 - RNA, 2278 nt, Artificial Sequence
  ZIKV (strain MR 766) prME-short variant mRNA Design 3 wild type
gggagaaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10648 - RNA, 2290 nt, Artificial Sequence
  ZIKV (strain NatalRGN) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10649 - RNA, 2308 nt, Artificial Sequence
  ZIKV (strain ZikaSPH2015) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10650 - RNA, 2308 nt, Artificial Sequence
  ZIKV (isolate Z1106033) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10651 - RNA, 2296 nt, Artificial Sequence
  ZIKV (strain MR 766) prME-short variant mRNA Design 3 wild type
gggagaaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10652 - RNA, 2308 nt, Artificial Sequence
  ZIKV (strain NatalRGN) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10653 - RNA, 2311 nt, Artificial Sequence
  ZIKV (strain ZikaSPH2015) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10654 - RNA, 2311 nt, Artificial Sequence
  ZIKV (isolate Z1106033) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10655 - RNA, 2299 nt, Artificial Sequence
  ZIKV (strain MR 766) prME-short variant mRNA Design 3 wild type
gggagaaagcuuaccauggccauaaguggagucccugugcuaggauuuuucaucauagcugugcugaugagcgcucaggaaucaugggcuaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10656 - RNA, 2311 nt, Artificial Sequence
  ZIKV (strain NatalRGN) prME-short variant mRNA Design 3 wild type
gggagaaagcuuaccauggccauaaguggagucccugugcuaggauuuuucaucauagcugugcugaugagcgcucaggaaucaugggcugucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10657 - RNA, 2290 nt, Artificial Sequence
  ZIKV (strain ZikaSPH2015) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10658 - RNA, 2290 nt, Artificial Sequence
  ZIKV (isolate Z1106033) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10659 - RNA, 2278 nt, Artificial Sequence
  ZIKV (strain MR 766) prME-short variant mRNA Design 3 wild type
gggagaaagcuuaccauggacuggaccuggauccuguuccucguggccgccgcgacccgcguccacagcaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10660 - RNA, 2290 nt, Artificial Sequence
  ZIKV (strain NatalRGN) prME-short variant mRNA Design 3 wild type
gggagaaagcuuaccauggacuggaccuggauccuguuccucguggccgccgcgacccgcguccacagcgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10661 - RNA, 2308 nt, Artificial Sequence
  ZIKV (strain ZikaSPH2015) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10662 - RNA, 2308 nt, Artificial Sequence
  ZIKV (isolate Z1106033) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacacgugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10663 - RNA, 2296 nt, Artificial Sequence
  ZIKV (strain MR 766) prME-short variant mRNA Design 3 wild type
gggagaaagcuuaccauggguaaacggagcgcuggcucaaucauguggcucgcgagcuuggcaguugucauagcuugugcaggagccaucacuagacgcgggagugcauacuacauguacuuggauaggagcgaugccgggaaggccauuucguuugcuaccacauugggagugaacaagugccacguacagaucauggaccucgggcacaugugugacgccaccaugaguuaugagugcccuaugcuggaugagggaguggaaccagaugaugucgauugcuggugcaacacgacaucaacuuggguuguguacggaaccugucaucacaaaaaaggugaggcacggcgaucuagaagagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10664 - RNA, 2308 nt, Artificial Sequence
  ZIKV (strain NatalRGN) prME-short variant mRNA Design 3 wild type
gggagaaagcuuaccauggguaaacggagcgcuggcucaaucauguggcucgcgagcuuggcaguugucauagcuugugcaggagccgucacuagacgugggagugcauacuauauguacuuggacagaaacgaugcuggggaggccauaucuuuuccaaccacauuggggaugaauaaguguuauauacagaucauggaucuuggacacaugugugaugccaccaugagcuaugaaugcccuaugcuggaugaggggguggaaccagaugacgucgauuguuggugcaacacgacgucaacuuggguuguguacggaaccugccaucacaaaaaaggugaagcacggagaucuagaagagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcacgcugggcaaggccuuuucaacaacuuugaagggagcucaaagacuggcagcguugggcgacacagccugggacuuuggcucuauuggaggggucuucaacuccauaggaagagccguucaccaaguguuugguggugccuucagaacacucuuugggggaaugucuuggaucacacaagggcuaaugggugcccuacugcucuggaugggcgucaacgcacgagaccgaucaauugcuuuggccuucuuagccacaggaggugugcucguguucuuagcgaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10665 - RNA, 2011 nt, Artificial Sequence
  ZIKV (strain ZikaSPH2015) ME variant mRNA Design 3 wild type
gggagaaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10666 - RNA, 2011 nt, Artificial Sequence
  ZIKV (isolate Z1106033) ME variant mRNA Design 3 wild type
gggagaaagcuuaccaugacgagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10667 - RNA, 1999 nt, Artificial Sequence
  ZIKV (strain MR 766) ME variant mRNA Design 3 wild type
gggagaaagcuuaccaugaccagcaucggaaucauuggccuccugcugacuacagccauggcagccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10668 - RNA, 2011 nt, Artificial Sequence
  ZIKV (strain NatalRGN) ME variant mRNA Design 3 wild type
gggagaaagcuuaccaugaccagugucggaauuguuggccuccugcugaccacagcuauggcagcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10669 - RNA, 2038 nt, Artificial Sequence
  ZIKV (strain ZikaSPH2015) ME variant mRNA Design 3 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10670 - RNA, 2038 nt, Artificial Sequence
  ZIKV (isolate Z1106033) ME variant mRNA Design 3 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10671 - RNA, 2026 nt, Artificial Sequence
  ZIKV (strain MR 766) ME variant mRNA Design 3 wild type
gggagaaagcuuaccauggccauaaguggagucccugugcuaggauuuuucaucauagcugugcugaugagcgcucaggaaucaugggcugccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10672 - RNA, 2038 nt, Artificial Sequence
  ZIKV (strain NatalRGN) ME variant mRNA Design 3 wild type
gggagaaagcuuaccauggccauaaguggagucccugugcuaggauuuuucaucauagcugugcugaugagcgcucaggaaucaugggcugcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10673 - RNA, 2017 nt, Artificial Sequence
  ZIKV (strain ZikaSPH2015) ME variant mRNA Design 3 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10674 - RNA, 2017 nt, Artificial Sequence
  ZIKV (isolate Z1106033) ME variant mRNA Design 3 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10675 - RNA, 2005 nt, Artificial Sequence
  ZIKV (strain MR 766) ME variant mRNA Design 3 wild type
gggagaaagcuuaccauggacuggaccuggauccuguuccucguggccgccgcgacccgcguccacagcgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10676 - RNA, 2017 nt, Artificial Sequence
  ZIKV (strain NatalRGN) ME variant mRNA Design 3 wild type
gggagaaagcuuaccauggacuggaccuggauccuguuccucguggccgccgcgacccgcguccacagcgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10677 - RNA, 2035 nt, Artificial Sequence
  ZIKV (strain ZikaSPH2015) ME variant mRNA Design 3 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauauugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagucuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauucucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10678 - RNA, 2035 nt, Artificial Sequence
  ZIKV (isolate Z1106033) ME variant mRNA Design 3 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucacuguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaaaguugagauaacgcccaauucaccaagagccgaagccacccuggggggguuuggaagccuaggacuugauugugaaccgaggacaggccuugacuuuucagauuuguauuacuugacuaugaauaacaagcacuggcugguucacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguacugcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaaucuuuggagcagcuuucaaaucauuguuuggaggaauguccugguucucacaaauucucauuggaacguugcugaugugguugggucugaacgcaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10679 - RNA, 2023 nt, Artificial Sequence
  ZIKV (strain MR 766) ME variant mRNA Design 3 wild type
gggagaaagcuuaccauggguaaacggagcgcuggcucaaucauguggcucgcgagcuuggcaguugucauagcuugugcaggagccgccgugacgcucccuucucacucuacaaggaaguugcaaacgcggucgcagaccugguuagaaucaagagaauacacgaagcacuugaucaagguugaaaacuggauauucaggaaccccggguuugcgcuaguggccguugccauugccuggcuuuugggaagcucgacgagccaaaaagucauauacuuggucaugauacugcugauugccccggcauacaguaucaggugcauuggagucagcaauagagacuucguggagggcaugucaggugggaccuggguugauguugucuuggaacauggaggcugcguuaccgugauggcacaggacaagccaacagucgacauagaguuggucacgacgacgguuaguaacauggccgagguaagauccuauugcuacgaggcaucgauaucggacauggcuucggacagucguugcccaacacaaggugaagccuaccuugacaagcaaucagacacucaauaugucugcaaaagaacauuaguggacagagguuggggaaacgguuguggacuuuuuggcaaagggagcuuggugacaugugccaaguuuacguguucuaagaagaugaccgggaagagcauucaaccggaaaaucuggaguaucggauaaugcuaucagugcauggcucccagcauagcgggaugauuggauaugaaacugacgaagauagagcgaaagucgagguuacgccuaauucaccaagagcggaagcaaccuugggaggcuuuggaaguuuaggacuugacugugaaccaaggacaggccuugacuuuucagaucuguauuaccugaccaugaacaauaagcauugguuggugcacaaagagugguuucaugacaucccauugccuuggcaugcuggggcagacaccggaacuccacacuggaacaacaaagaggcauugguagaauuuaaggaugcccacgccaagaggcaaaccgucgucguucuggggagccaggaaggagccguucacacggcucucgcuggagcucuagaggcugagauggauggugcaaagggaaggcuguucucuggccauuugaaaugccgccuaaaaauggacaagcucagauugaagggcgugucauauuccuugugcacugcggcauucacauucaccaaggucccagcugaaacacugcauggaacagucacaguggaggugcaguaugcagggacagauggacccugcaagaucccaguccagauggcgguggacaugcagacccugaccccaguuggaaggcugauaaccgccaaccccgugauuacugaaagcacugagaacucaaagaugauguuggagcuugacccaccauuuggggauucuuacauugucauaggaguuggggacaagaaaaucacccaccacuggcauaggagugguagcaccaucggaaaggcauuugaggccacugugagaggcgccaagagaauggcaguccugggggauacagccugggacuucggaucagucggggguguguucaacucacuggguaagggcauucaccagauuuuuggagcagccuucaaaucacuguuuggaggaauguccugguucucacagauccucauaggcacgcugcuagugugguuagguuugaacacaaagaauggaucuaucucccucacaugcuuggcccuggggggagugaugaucuuccucuccacggcuguuucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10680 - RNA, 2035 nt, Artificial Sequence
  ZIKV (strain NatalRGN) ME variant mRNA Design 3 wild type
gggagaaagcuuaccauggguaaacggagcgcuggcucaaucauguggcucgcgagcuuggcaguugucauagcuugugcaggagccgcugugacgcuccccucccauuccacuaggaagcugcaaacgcggucgcaaaccugguuggaaucaagagaauacacaaagcacuugauuagagucgaaaauuggauauucaggaacccuggcuucgcguuagcagcagcugccaucgcuuggcuuuugggaagcucaacgagccaaaaagucauauacuuggucaugauacugcugauugccccggcauacagcaucaggugcauaggagucagcaauagggacuuuguggaagguaugucaggugggacuuggguugauguugucuuggaacauggagguugugucaccguaauggcacaggacaaaccgacugucgacauagagcugguuacaacaacagucagcaacauggcggagguaagauccuacugcuaugaggcaucaauaucagacauggcuucggacagccgcugcccaacacaaggugaagccuaccuugacaagcaaucagacacucaauaugucugcaaaagaacguuaguggacagaggcuggggaaauggauguggacuuuuuggcaaagggagccuggugacaugcgcuaaguuugcaugcuccaagaaaaugaccgggaagagcauccagccagagaaucuggaguaccggauaaugcugucaguucauggcucccagcacagugggaugaucguuaaugacacaggacaugaaacugaugagaauagagcgaagguugagauaacgcccaauucaccaagagccgaagccacccugggggguuuuggaagccuaggacuugauugugaaccgaggacaggccuugacuuuucagauuuguauuacuugacuaugaauaacaagcacugguugguccacaaggagugguuccacgacauuccauuaccuuggcacgcuggggcagacaccggaacuccacacuggaacaacaaagaagcacugguagaguucaaggacgcacaugccaaaaggcaaacugucgugguucuagggagucaagaaggagcaguucacacggcccuugcuggagcucuggaggcugagauggauggugcaaagggaaggcuguccucuggccacuugaaaugucgccugaaaauggauaaacuuagauugaagggcgugucauacuccuuguguaccgcagcguucacauucaccaagaucccggcugaaacacugcacgggacagucacaguggagguacaguacgcagggacagauggaccuugcaagguuccagcucagauggcgguggacaugcaaacucugaccccaguugggagguugauaaccgcuaaccccguaaucacugaaagcacugagaacucuaagaugaugcuggaacuugauccaccauuuggggacucuuacauugucauaggagucggggagaagaagaucacccaccacuggcacaggaguggcagcaccauuggaaaagcauuugaagccacugugagaggugccaagagaauggcagucuugggagacacagccugggacuuuggaucaguuggaggcgcucucaacucauugggcaagggcauccaucaaauuuuuggagcagcuuucaaaucauuguuuggaggaauguccugguucucacaaauccucauuggaacguugcugaugugguugggucugaacacaaagaauggaucuauuucccuuaugugcuuggccuuagggggaguguugaucuucuuauccacagccgucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10681 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10682 - RNA, 2311 nt, Artificial Sequence
  ZIKV (isolate Z1106033) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10683 - RNA, 2299 nt, Artificial Sequence
  ZIKV (strain MR 766) prME-short variant mRNA Design 3 opt
gggagaaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10684 - RNA, 2311 nt, Artificial Sequence
  ZIKV (strain NatalRGN) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10685 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10686 - RNA, 2290 nt, Artificial Sequence
  ZIKV (isolate Z1106033) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10687 - RNA, 2278 nt, Artificial Sequence
  ZIKV (strain MR 766) prME-short variant mRNA Design 3 opt
gggagaaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10688 - RNA, 2290 nt, Artificial Sequence
  ZIKV (strain NatalRGN) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10689 - RNA, 2308 nt, Artificial Sequence
  ZIKV (strain ZikaSPH2015) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10690 - RNA, 2308 nt, Artificial Sequence
  ZIKV (isolate Z1106033) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10691 - RNA, 2296 nt, Artificial Sequence
  ZIKV (strain MR 766) prME-short variant mRNA Design 3 opt
gggagaaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10692 - RNA, 2308 nt, Artificial Sequence
  ZIKV (strain NatalRGN) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10693 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10694 - RNA, 2311 nt, Artificial Sequence
  ZIKV (isolate Z1106033) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10695 - RNA, 2299 nt, Artificial Sequence
  ZIKV (strain MR 766) prME-short variant mRNA Design 3 opt
gggagaaagcuuaccauggccaucagcggcgugcccguccugggguucuucaucaucgccgugcucauguccgcgcaggagagcugggccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10696 - RNA, 2311 nt, Artificial Sequence
  ZIKV (strain NatalRGN) prME-short variant mRNA Design 3 opt
gggagaaagcuuaccauggccaucagcggcgugcccguccugggguucuucaucaucgccgugcucauguccgcgcaggagagcugggccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10697 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10698 - RNA, 2290 nt, Artificial Sequence
  ZIKV (isolate Z1106033) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10699 - RNA, 2278 nt, Artificial Sequence
  ZIKV (strain MR 766) prME-short variant mRNA Design 3 opt
gggagaaagcuuaccauggacuggaccuggauccuguuccucguggccgccgcgacccgcguccacagcaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10700 - RNA, 2290 nt, Artificial Sequence
  ZIKV (strain NatalRGN) prME-short variant mRNA Design 3 opt
gggagaaagcuuaccauggacuggaccuggauccuguuccucguggccgccgcgacccgcguccacagcgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10701 - RNA, 2308 nt, Artificial Sequence
  ZIKV (strain ZikaSPH2015) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10702 - RNA, 2308 nt, Artificial Sequence
  ZIKV (isolate Z1106033) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacacgugcgacgcgaccauguccuacgagugccccaugcucgacgagggcguggagcccgacgacguggacugcuggugcaacaccacgagcaccugggucguguacggcacgugccaccacaagaagggggaggcccgccggucccgccgggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10703 - RNA, 2296 nt, Artificial Sequence
  ZIKV (strain MR 766) prME-short variant mRNA Design 3 opt
gggagaaagcuuaccaugggcaagcgcagcgccggguccaucauguggcuggccagccucgcgguggucaucgccugcgccggcgccaucacccgccggggguccgccuacuacauguaccuggaccgcagcgacgccggcaaggccaucuccuucgcgaccacgcugggcgugaacaagugccacgugcagaucauggaccucgggcacaugugcgacgccaccaugagcuacgagugcccgaugcuggacgagggcgucgagcccgacgacguggacugcuggugcaacaccaccuccacguggguggucuacgggaccugccaccacaagaagggcgaggcccggcgcagccggcgcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10704 - RNA, 2308 nt, Artificial Sequence
  ZIKV (strain NatalRGN) prME-short variant mRNA Design 3 opt
gggagaaagcuuaccaugggcaagcgcagcgccggguccaucauguggcuggccagccucgcgguggucaucgccugcgccggcgccgucacccggcgcggcuccgccuacuacauguaccucgaccggaacgacgccggggaggccaucagcuucccgaccacgcugggcaugaacaagugcuacauccagaucauggaccuggggcacaugugcgacgcgaccauguccuacgagugccccaugcucgacgagggcguggagcccgacgacguggacugcuggugcaacaccaccagcacgugggucguguacggcacgugccaccacaagaagggggaggcccgccggucccgccgggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcagcacccuggggaaggccuucuccaccacgcucaagggcgcccagcgccuggcggcccugggggacaccgccugggacuucggcagcaucgggggcguguucaacuccaucggccgggccguccaccagguguucgggggcgccuuccgcacccucuucgggggcaugagcuggaucacccaggggcugaugggcgcgcugcuccuguggaugggggugaacgcccgggaccgcuccaucgcccuggccuuccucgcgacgggcggcguccugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10705 - RNA, 2011 nt, Artificial Sequence
  ZIKV (strain ZikaSPH2015) ME variant mRNA Design 3 opt
gggagaaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10706 - RNA, 2011 nt, Artificial Sequence
  ZIKV (isolate Z1106033) ME variant mRNA Design 3 opt
gggagaaagcuuaccaugaccagcguggggaucgugggccuccugcugacgaccgccauggcggccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10707 - RNA, 1999 nt, Artificial Sequence
  ZIKV (strain MR 766) ME variant mRNA Design 3 opt
gggagaaagcuuaccaugaccagcaucgggaucaucggccugcugcucacgaccgccauggcggccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10708 - RNA, 2011 nt, Artificial Sequence
  ZIKV (strain NatalRGN) ME variant mRNA Design 3 opt
gggagaaagcuuaccaugaccagcguggggaucgugggccuccugcugacgaccgccauggcggccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10709 - RNA, 2038 nt, Artificial Sequence
  ZIKV (strain ZikaSPH2015) ME variant mRNA Design 3 opt
gggagaaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10710 - RNA, 2038 nt, Artificial Sequence
  ZIKV (isolate Z1106033) ME variant mRNA Design 3 opt
gggagaaagcuuaccauggccaucagcggcgugcccguccugggguucuucaucaucgccgugcucauguccgcgcaggagagcugggccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10711 - RNA, 2026 nt, Artificial Sequence
  ZIKV (strain MR 766) ME variant mRNA Design 3 opt
gggagaaagcuuaccauggccaucagcggcgugcccguccugggguucuucaucaucgccgugcucauguccgcgcaggagagcugggccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10712 - RNA, 2038 nt, Artificial Sequence
  ZIKV (strain NatalRGN) ME variant mRNA Design 3 opt
gggagaaagcuuaccauggccaucagcggcgugcccguccugggguucuucaucaucgccgugcucauguccgcgcaggagagcugggccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10713 - RNA, 2017 nt, Artificial Sequence
  ZIKV (strain ZikaSPH2015) ME variant mRNA Design 3 opt
gggagaaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10714 - RNA, 2017 nt, Artificial Sequence
  ZIKV (isolate Z1106033) ME variant mRNA Design 3 opt
gggagaaagcuuaccauggacuggaccuggauccuguuccucguggccgccgcgacccgcguccacagcgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10715 - RNA, 2005 nt, Artificial Sequence
  ZIKV (strain MR 766) ME variant mRNA Design 3 opt
gggagaaagcuuaccauggacuggaccuggauccuguuccucguggccgccgcgacccgcguccacagcgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10716 - RNA, 2017 nt, Artificial Sequence
  ZIKV (strain NatalRGN) ME variant mRNA Design 3 opt
gggagaaagcuuaccauggacuggaccuggauccuguuccucguggccgccgcgacccgcguccacagcgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10717 - RNA, 2035 nt, Artificial Sequence
  ZIKV (strain ZikaSPH2015) ME variant mRNA Design 3 opt
gggagaaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacaucguccuggagcacgggggcugcgugaccgugauggcccaggacaagcccaccgucgacaucgagcucgugaccacgaccgugagcaacauggccgagguccgcagcuacugcuacgaggccuccaucagcgacauggccuccgacagccggugccccacccagggggaggcguaccuggacaagcaguccgacacccaguacgugugcaagcgcacgcuggucgaccggggcugggggaacggcugcggccucuucgggaagggcagccuggugaccugcgccaaguucgccugcuccaagaagaugaccgggaagagcauccagccggagaaccuggaguaccgcaucaugcucuccgugcacggcagccagcacuccgggaugaucgucaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcuggugcacaaggagugguuccacgacaucccgcugcccuggcacgccggcgccgacaccgggaccccgcacuggaacaacaaggaggcccucgucgaguucaaggacgcgcacgccaagcgccagaccguggugguccugggcucccaggagggggccgugcacacggcccuggccggcgcgcuggaggccgagauggacggggccaagggccggcucagcuccggccaccugaagugccgccugaagauggacaagcuccggcugaagggggugagcuacucccugugcaccgccgccuucaccuucaccaagauccccgcggagacccuccacggcacggucaccguggaggugcaguacgccgggaccgacggcccgugcaagguccccgcccagauggccguggacaugcagacccugacgcccguggggcgccugaucaccgcgaaccccgucaucaccgagagcaccgagaacagcaagaugaugcucgagcuggacccgcccuucggcgacuccuacaucgugaucggcgugggggagaagaagaucacgcaccacuggcaccggagcggcuccaccaucgggaaggccuucgaggccaccguccgcggcgccaagcggauggccgugcugggggacaccgcgugggacuucggcagcgugggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcguccugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10718 - RNA, 2035 nt, Artificial Sequence
  ZIKV (isolate Z1106033) ME variant mRNA Design 3 opt
gggagaaagcuuaccaugggcaagcgcagcgccggguccaucauguggcuggccagccucgcgguggucaucgccugcgccggcgccgccgugacccugcccagccacuccacgcgcaagcugcagacccggagccagaccuggcucgagucccgcgaguacaccaagcaccugauccgggucgagaacuggaucuuccgcaacccgggcuucgcccuggccgcggccgccaucgccuggcuccuggggagcuccacgagccagaaggugaucuaccuggugaugauccuccugaucgcccccgcguacuccauccgcugcaucggcgucagcaaccgggacuucguggaggggauguccggcggcaccuggguggacgucgugcuggagcacgggggcugcgugaccgucauggcccaggacaagcccaccguggacaucgagcucgugacgaccaccgucagcaacauggccgaggugcgcagcuacugcuacgaggccuccaucagcgacauggccuccgacagccggugccccacccagggggaggcguaccuggacaagcaguccgacacgcaguacgucugcaagcgcacccugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacacgggccacgagaccgacgagaaccgggccaagguggagaucacccccaacagcccccgcgcggaggccacccugggcggguucggcucccuggggcucgacugcgagccccggacgggccuggacuucagcgaccuguacuaccucaccaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagacgguggucgugcugggcucccaggagggggccgugcacaccgcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacgcuccacggcaccgugaccguggagguccaguacgccgggaccgacggcccgugcaaggugcccgcccagauggccguggacaugcagacgcugacccccgucgggcgccugaucaccgcgaaccccgugaucaccgagagcacggagaacagcaagaugaugcucgagcuggacccgcccuucggcgacuccuacaucgugaucggcgucggggagaagaagaucacccaccacuggcaccggagcggcuccaccaucgggaaggccuucgaggccaccgugcgcggcgccaagcggauggccgugcugggggacacggcgugggacuucggcagcgucggcggggcccucaacucccugggcaaggggauccaccagaucuucggcgccgccuucaagagccuguucgggggcauguccugguucagccagauccucaucggcacccugcugauguggcucgggcugaacgccaagaacggcuccaucagccugaugugccucgcgcugggcggcgugcugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10719 - RNA, 2023 nt, Artificial Sequence
  ZIKV (strain MR 766) ME variant mRNA Design 3 opt
gggagaaagcuuaccaugggcaagcgcagcgccggguccaucauguggcuggccagccucgcgguggucaucgccugcgccggcgccgccgugacccugcccucccacagcacccggaagcuccagacgcgcucccagaccuggcuggagagccgcgaguacaccaagcaccugaucaagguggagaacuggaucuuccggaaccccggcuucgcccucgucgcgguggccaucgccuggcugcugggguccagcaccucccagaaggugaucuaccucgucaugauccugcugaucgccccggccuacagcauccgcugcaucggcguguccaaccgggacuucguggaggggaugagcggcgggacgugggucgacguggugcucgagcacggcggcugcgucaccgugauggcgcaggacaagcccaccguggacaucgagcuggucaccacgaccguguccaacauggccgagguccgcagcuacugcuacgaggccagcaucuccgacauggccagcgacucccggugccccacccagggggaggccuaccuggacaagcagagcgacacccaguacgugugcaagcgcacgcucguggaccggggcugggggaacggcugcgggcuguucggcaagggcucccuggucacgugcgcgaaguucacgugcagcaagaagaugaccgggaaguccauccagcccgagaaccucgaguaccgcaucaugcugagcgugcacggcucccagcacagcgggaugaucggcuacgagacggacgaggaccgggccaagguggaggucaccccgaacuccccgcgcgccgaggccacccugggcggguucggcagccucgggcuggacugcgagccccggaccggccuggacuucuccgaccucuacuaccugacgaugaacaacaagcacuggcuggugcacaaggagugguuccacgacaucccccucccguggcacgcgggggccgacaccggcaccccgcacuggaacaacaaggaggcccugguggaguucaaggacgcccacgccaagcgccagaccgucguggugcugggcagccaggagggggcgguccacacggcccuggccggcgcccucgaggccgagauggacggggcgaagggccggcuguucuccgggcaccugaagugccgccucaagauggacaagcugcggcugaagggcgugagcuacucccucugcaccgccgccuucaccuucaccaaggugcccgccgagacccugcacggcacggucaccguggaggugcaguacgccgggaccgacggccccugcaagaucccgguccagauggcgguggacaugcagacccugacgcccguggggcgccucaucaccgccaaccccgucaucaccgagagcaccgagaacuccaagaugaugcuggagcuggacccgccguucggcgacagcuacaucgugaucggggugggcgacaagaagaucacgcaccacuggcaccggagcggcuccaccaucgggaaggccuucgaggccaccguccgcggcgcgaagcggauggccgugcucggggacaccgccugggacuucggcagcgugggcggcgucuucaacucccuggggaaggggauccaccagaucuucggcgccgccuucaagagccuguucgggggcauguccugguucagccagauccucaucgggacgcugcugguguggcucggccugaacaccaagaacggcuccaucagccugaccugccucgcgcugggcggcgugaugaucuuccuguccaccgccgucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10720 - RNA, 2035 nt, Artificial Sequence
  ZIKV (strain NatalRGN) ME variant mRNA Design 3 opt
gggagaaagcuuaccaugggcaagcgcagcgccggguccaucauguggcuggccagccucgcgguggucaucgccugcgccggcgccgccgugacccugcccagccacuccacccgcaagcugcagacgcggagccagaccuggcucgagucccgcgaguacaccaagcaccugauccgggucgagaacuggaucuuccgcaacccgggcuucgcccuggccgcggccgccaucgccuggcuccuggggagcuccaccagccagaaggugaucuaccuggugaugauccuccugaucgcccccgcguacuccauccgcugcaucggcgucagcaaccgggacuucguggaggggauguccggcggcacguggguggacgucgugcuggagcacgggggcugcgugaccgucauggcccaggacaagcccaccguggacaucgagcucgugaccacgaccgucagcaacauggccgaggugcgcagcuacugcuacgaggccuccaucagcgacauggccuccgacagccggugccccacccagggggaggcguaccuggacaagcaguccgacacccaguacgucugcaagcgcacgcugguggaccggggcugggggaacggcugcggccucuucgggaagggcagccuggugaccugcgccaaguucgccugcuccaagaagaugaccgggaagagcauccagccggagaaccuggaguaccgcaucaugcucuccguccacggcagccagcacuccgggaugaucgugaacgacaccggccacgagacggacgagaaccgggccaagguggagaucacccccaacagcccccgcgcggaggccacccugggcggguucggcucccuggggcucgacugcgagccccggaccggccuggacuucagcgaccuguacuaccucacgaugaacaacaagcacuggcugguccacaaggagugguuccacgacaucccgcugcccuggcacgccggcgccgacaccgggaccccgcacuggaacaacaaggaggcccucguggaguucaaggacgcgcacgccaagcgccagaccguggucgugcugggcucccaggagggggccgugcacacggcccuggccggcgcgcuggaggccgagauggacggggccaagggccggcucagcuccggccaccugaagugccgccugaagauggacaagcuccggcugaagggggucagcuacucccugugcaccgccgccuucaccuucaccaagauccccgcggagacccuccacggcacggugaccguggagguccaguacgccgggaccgacggcccgugcaaggugcccgcccagauggccguggacaugcagacccugacgcccgucgggcgccugaucaccgcgaaccccgugaucaccgagagcaccgagaacagcaagaugaugcucgagcuggacccgcccuucggcgacuccuacaucgugaucggcgucggggagaagaagaucacgcaccacuggcaccggagcggcuccaccaucgggaaggccuucgaggccaccgugcgcggcgccaagcggauggccgugcugggggacaccgcgugggacuucggcagcgucggcggggcccucaacucccugggcaaggggauccaccagaucuucggcgccgccuucaagagccuguucgggggcauguccugguucagccagauccucaucggcacgcugcugauguggcucgggcugaacaccaagaacggcuccaucagccugaugugccucgcccugggcggcgugcugaucuuccucuccaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10721 - RNA, 2311 nt, Artificial Sequence
  ZIKV (strain ZikaSPH2015) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10722 - RNA, 2311 nt, Artificial Sequence
  ZIKV (isolate Z1106033) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10723 - RNA, 2299 nt, Artificial Sequence
  ZIKV (strain MR 766) prME-short variant mRNA Design 3 opt
gggagaaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10724 - RNA, 2311 nt, Artificial Sequence
  ZIKV (strain NatalRGN) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10725 - RNA, 2290 nt, Artificial Sequence
  ZIKV (strain ZikaSPH2015) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10726 - RNA, 2290 nt, Artificial Sequence
  ZIKV (isolate Z1106033) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10727 - RNA, 2278 nt, Artificial Sequence
  ZIKV (strain MR 766) prME-short variant mRNA Design 3 opt
gggagaaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10728 - RNA, 2290 nt, Artificial Sequence
  ZIKV (strain NatalRGN) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10729 - RNA, 2308 nt, Artificial Sequence
  ZIKV (strain ZikaSPH2015) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10730 - RNA, 2308 nt, Artificial Sequence
  ZIKV (isolate Z1106033) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10731 - RNA, 2296 nt, Artificial Sequence
  ZIKV (strain MR 766) prME-short variant mRNA Design 3 opt
gggagaaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10732 - RNA, 2308 nt, Artificial Sequence
  ZIKV (strain NatalRGN) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10733 - RNA, 2311 nt, Artificial Sequence
  ZIKV (strain ZikaSPH2015) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10734 - RNA, 2311 nt, Artificial Sequence
  ZIKV (isolate Z1106033) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10735 - RNA, 2299 nt, Artificial Sequence
  ZIKV (strain MR 766) prME-short variant mRNA Design 3 opt
gggagaaagcuuaccauggccaucuccggcguccccguccucggcuucuucaucaucgccguccucauguccgcccaggaguccugggccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10736 - RNA, 2311 nt, Artificial Sequence
  ZIKV (strain NatalRGN) prME-short variant mRNA Design 3 opt
gggagaaagcuuaccauggccaucuccggcguccccguccucggcuucuucaucaucgccguccucauguccgcccaggaguccugggccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10737 - RNA, 2290 nt, Artificial Sequence
  ZIKV (strain ZikaSPH2015) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10738 - RNA, 2290 nt, Artificial Sequence
  ZIKV (isolate Z1106033) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10739 - RNA, 2278 nt, Artificial Sequence
  ZIKV (strain MR 766) prME-short variant mRNA Design 3 opt
gggagaaagcuuaccauggacuggaccuggauccucuuccucgucgccgccgccacccgcguccacuccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10740 - RNA, 2290 nt, Artificial Sequence
  ZIKV (strain NatalRGN) prME-short variant mRNA Design 3 opt
gggagaaagcuuaccauggacuggaccuggauccucuuccucgucgccgccgccacccgcguccacuccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10741 - RNA, 2308 nt, Artificial Sequence
  ZIKV (strain ZikaSPH2015) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10742 - RNA, 2308 nt, Artificial Sequence
  ZIKV (isolate Z1106033) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaccugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10743 - RNA, 2296 nt, Artificial Sequence
  ZIKV (strain MR 766) prME-short variant mRNA Design 3 opt
gggagaaagcuuaccaugggcaagcgcuccgccggcuccaucauguggcucgccucccucgccgucgucaucgccugcgccggcgccaucacccgccgcggcuccgccuacuacauguaccucgaccgcuccgacgccggcaaggccaucuccuucgccaccacccucggcgucaacaagugccacguccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10744 - RNA, 2308 nt, Artificial Sequence
  ZIKV (strain NatalRGN) prME-short variant mRNA Design 3 opt
gggagaaagcuuaccaugggcaagcgcuccgccggcuccaucauguggcucgccucccucgccgucgucaucgccugcgccggcgccgucacccgccgcggcuccgccuacuacauguaccucgaccgcaacgacgccggcgaggccaucuccuuccccaccacccucggcaugaacaagugcuacauccagaucauggaccucggccacaugugcgacgccaccauguccuacgagugccccaugcucgacgagggcgucgagcccgacgacgucgacugcuggugcaacaccaccuccaccugggucgucuacggcaccugccaccacaagaagggcgaggcccgccgcucccgccgcgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccacccucggcaaggccuucuccaccacccucaagggcgcccagcgccucgccgcccucggcgacaccgccugggacuucggcuccaucggcggcgucuucaacuccaucggccgcgccguccaccaggucuucggcggcgccuuccgcacccucuucggcggcauguccuggaucacccagggccucaugggcgcccuccuccucuggaugggcgucaacgcccgcgaccgcuccaucgcccucgccuuccucgccaccggcggcguccucgucuuccucgccaccaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10745 - RNA, 2011 nt, Artificial Sequence
  ZIKV (strain ZikaSPH2015) ME variant mRNA Design 3 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10746 - RNA, 2011 nt, Artificial Sequence
  ZIKV (isolate Z1106033) ME variant mRNA Design 3 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10747 - RNA, 1999 nt, Artificial Sequence
  ZIKV (strain MR 766) ME variant mRNA Design 3 opt
gggagaaagcuuaccaugaccuccaucggcaucaucggccuccuccucaccaccgccauggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10748 - RNA, 2011 nt, Artificial Sequence
  ZIKV (strain NatalRGN) ME variant mRNA Design 3 opt
gggagaaagcuuaccaugaccuccgucggcaucgucggccuccuccucaccaccgccauggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10749 - RNA, 2038 nt, Artificial Sequence
  ZIKV (strain ZikaSPH2015) ME variant mRNA Design 3 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10750 - RNA, 2038 nt, Artificial Sequence
  ZIKV (isolate Z1106033) ME variant mRNA Design 3 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10751 - RNA, 2026 nt, Artificial Sequence
  ZIKV (strain MR 766) ME variant mRNA Design 3 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10752 - RNA, 2038 nt, Artificial Sequence
  ZIKV (strain NatalRGN) ME variant mRNA Design 3 opt
gggagaaagcuuaccauggccaucuccggcguccccguccucggcuucuucaucaucgccguccucauguccgcccaggaguccugggccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10753 - RNA, 2017 nt, Artificial Sequence
  ZIKV (strain ZikaSPH2015) ME variant mRNA Design 3 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10754 - RNA, 2017 nt, Artificial Sequence
  ZIKV (isolate Z1106033) ME variant mRNA Design 3 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10755 - RNA, 2005 nt, Artificial Sequence
  ZIKV (strain MR 766) ME variant mRNA Design 3 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10756 - RNA, 2017 nt, Artificial Sequence
  ZIKV (strain NatalRGN) ME variant mRNA Design 3 opt
gggagaaagcuuaccauggacuggaccuggauccucuuccucgucgccgccgccacccgcguccacuccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10757 - RNA, 2035 nt, Artificial Sequence
  ZIKV (strain ZikaSPH2015) ME variant mRNA Design 3 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacaucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10758 - RNA, 2035 nt, Artificial Sequence
  ZIKV (isolate Z1106033) ME variant mRNA Design 3 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacgccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10759 - RNA, 2023 nt, Artificial Sequence
  ZIKV (strain MR 766) ME variant mRNA Design 3 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucaucaaggucgagaacuggaucuuccgcaaccccggcuucgcccucgucgccgucgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucaccugcuccaagaagaugaccggcaaguccauccagcccgagaaccucgaguaccgcaucaugcucuccguccacggcucccagcacuccggcaugaucggcuacgagaccgacgaggaccgcgccaaggucgaggucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuucuccggccaccucaagugccgccucaagauggacaagcuccgccucaagggcgucuccuacucccucugcaccgccgccuucaccuucaccaagguccccgccgagacccuccacggcaccgucaccgucgagguccaguacgccggcaccgacggccccugcaagauccccguccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgacaagaagaucacccaccacuggcaccgcuccggcuccaccaucggcaaggccuucgaggccaccguccgcggcgccaagcgcauggccguccucggcgacaccgccugggacuucggcuccgucggcggcgucuucaacucccucggcaagggcauccaccagaucuucggcgccgccuucaagucccucuucggcggcauguccugguucucccagauccucaucggcacccuccucgucuggcucggccucaacaccaagaacggcuccaucucccucaccugccucgcccucggcggcgucaugaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10760 - RNA, 2035 nt, Artificial Sequence
  ZIKV (strain NatalRGN) ME variant mRNA Design 3 opt
gggagaaagcuuaccaugggcaagcgcuccgccggcuccaucauguggcucgccucccucgccgucgucaucgccugcgccggcgccgccgucacccuccccucccacuccacccgcaagcuccagacccgcucccagaccuggcucgagucccgcgaguacaccaagcaccucauccgcgucgagaacuggaucuuccgcaaccccggcuucgcccucgccgccgccgccaucgccuggcuccucggcuccuccaccucccagaaggucaucuaccucgucaugauccuccucaucgcccccgccuacuccauccgcugcaucggcgucuccaaccgcgacuucgucgagggcauguccggcggcaccugggucgacgucguccucgagcacggcggcugcgucaccgucauggcccaggacaagcccaccgucgacaucgagcucgucaccaccaccgucuccaacauggccgagguccgcuccuacugcuacgaggccuccaucuccgacauggccuccgacucccgcugccccacccagggcgaggccuaccucgacaagcaguccgacacccaguacgucugcaagcgcacccucgucgaccgcggcuggggcaacggcugcggccucuucggcaagggcucccucgucaccugcgccaaguucgccugcuccaagaagaugaccggcaaguccauccagcccgagaaccucgaguaccgcaucaugcucuccguccacggcucccagcacuccggcaugaucgucaacgacaccggccacgagaccgacgagaaccgcgccaaggucgagaucacccccaacuccccccgcgccgaggccacccucggcggcuucggcucccucggccucgacugcgagccccgcaccggccucgacuucuccgaccucuacuaccucaccaugaacaacaagcacuggcucguccacaaggagugguuccacgacaucccccuccccuggcacgccggcgccgacaccggcaccccccacuggaacaacaaggaggcccucgucgaguucaaggacgcccacgccaagcgccagaccgucgucguccucggcucccaggagggcgccguccacaccgcccucgccggcgcccucgaggccgagauggacggcgccaagggccgccucuccuccggccaccucaagugccgccucaagauggacaagcuccgccucaagggcgucuccuacucccucugcaccgccgccuucaccuucaccaagauccccgccgagacccuccacggcaccgucaccgucgagguccaguacgccggcaccgacggccccugcaagguccccgcccagauggccgucgacaugcagacccucacccccgucggccgccucaucaccgccaaccccgucaucaccgaguccaccgagaacuccaagaugaugcucgagcucgacccccccuucggcgacuccuacaucgucaucggcgucggcgagaagaagaucacccaccacuggcaccgcuccggcuccaccaucggcaaggccuucgaggccaccguccgcggcgccaagcgcauggccguccucggcgacaccgccugggacuucggcuccgucggcggcgcccucaacucccucggcaagggcauccaccagaucuucggcgccgccuucaagucccucuucggcggcauguccugguucucccagauccucaucggcacccuccucauguggcucggccucaacaccaagaacggcuccaucucccucaugugccucgcccucggcggcguccucaucuuccucuccaccgccgucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10761 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgaucggaaaggccuucgaagcuaccgugcgcggugccaaaagaauggcaguacuaggcgauacugcuugggacuuuggguccgugggaggcgcccucaauucucuggguaaggggauucaccaaaucuucggcgcggccuuuaaaucgcuuuucggaggcaugagcugguuuucccagauuuugauagggacacugcucauguggcugggacuuaacaccaagaauggcucaaucagucugauguguuuggcucucggugggguucugauuuucuuaucuacagcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10762 - RNA, 2311 nt, Artificial Sequence
  ZIKV (isolate Z1106033) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcaccaucggaaaggccuucgaagcuacuguacgcggugccaaaagaauggcagugcuaggcgauacagcuugggacuuuggguccguuggaggcgcccucaauucucuggguaaggggauccaccaaauuuucggcgcggccuuuaaaucgcuuuucggaggcaugagcugguuuucccagaucuugauugggacccugcucauguggcugggacuuaacgcuaagaauggcucaauaagucugauguguuuggcacucggugggguccugaucuucuuaucuacagccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10763 - RNA, 2299 nt, Artificial Sequence
  ZIKV (strain MR 766) prME-short variant mRNA Design 3 opt
gggagaaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgauuggaaaggcuuuugaggccaccgugcggggugcaaaacgcauggccgugcuaggcgacacugcuugggauuucggguccgucggaggcguuuuuaauucucucgguaaggggauccaccaaaucuucggcgccgcauuuaaaucgcuguucggaggcaugagcugguuuucccagauucuuaucgggacauugcugguguggcucggacugaacaccaagaacggcucaauuagucuuacaugucuggcuuuggguggggugaugauauuccucucuacugccguaagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10764 - RNA, 2311 nt, Artificial Sequence
  ZIKV (strain NatalRGN) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgaucggaaaggccuucgaagcuaccguacgcggugccaaaagaauggcagugcuaggcgauacugcuugggacuuuggguccguuggaggcgcccucaauucucuggguaaggggauccaccaaauuuucggcgcggccuuuaaaucgcuuuucggaggcaugagcugguuuucccagaucuugauugggacacugcucauguggcugggacuuaacaccaagaauggcucaauaagucugauguguuuggcucucggugggguccugaucuucuuaucuacagcagugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10765 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacuauuggcaaggcauucgaggccacagucagaggggcuaaaaggauggccgugcuaggagacaccgcaugggauuucgguaguguaggcggggcucucaauagccugggaaagggcauccaucagaucuuuggugccgcguucaaaucccuuuuugggggcaugucuugguucucgcaaauuuugaucggaacacugcucauguggcugggccuuaacacuaagaaugggagcauuucccugauguguuuggcccucggaggcgugcugauauuuuuaucaaccgcuguuagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10766 - RNA, 2290 nt, Artificial Sequence
  ZIKV (isolate Z1106033) prME-short variant mRNA Design 3 opt
gggagaaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacaauaggcaaggcauucgaggccaccgugagaggggcuaaaaggauggccguacuaggagacacagcaugggauuucgguagugugggcggggcucucaauagccugggaaagggcauucaucagaucuuuggugccgcguucaaaucccuuuuugggggcaugucuugguucucgcaaaucuugauuggaacucugcucauguggcugggccuuaacgccaagaaugggagcaucucccugauguguuuggcucucggaggcguucugaucuuuuuaucaaccgcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10767 - RNA, 2278 nt, Artificial Sequence
  ZIKV (strain MR 766) prME-short variant mRNA Design 3 opt
gggagaaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacuaucggcaaggcguucgaagcuacaguccgcggggccaaaagaauggcagugcuaggagauaccgccugggacuuugguagugugggcggggucuucaauagccucggaaagggcauacaucagauuuuuggugcugccuucaaaucccuguuugggggcaugucuugguucucgcaaauccuuaucggaacauugcugguuuggcucggccugaacacuaagaacgggagcauuucccuuaccugucuggcauugggaggcgugaugaucuuucucucaacggcugugagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10768 - RNA, 2290 nt, Artificial Sequence
  ZIKV (strain NatalRGN) prME-short variant mRNA Design 3 opt
gggagaaagcuuaccauggacuggaccuggauucuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacuauaggcaaggcauucgaggccacagugagaggggcuaaaaggauggccguacuaggagacaccgcaugggauuucgguagugugggcggggcucucaauagccugggaaagggcauucaucagaucuuuggugccgcguucaaaucccuuuuugggggcaugucuugguucucgcaaaucuugauuggaacacugcucauguggcugggccuuaacacuaagaaugggagcaucucccugauguguuuggcccucggaggcguucugaucuuuuuaucaaccgcugucagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10769 - RNA, 2308 nt, Artificial Sequence
  ZIKV (strain ZikaSPH2015) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgaucgguaaagccuuugaggcaaccgucagaggcgcuaagaggauggccgugcuaggggauacugcgugggacuucggauccguaggcggugcccucaauucucuggggaaaggcauccaccagauuuucggagcugcauuuaagucgcuuuucggcgggaugagcugguuuucccaaaucuugauuggaacacugcucauguggcugggccuuaacaccaaaaaugguucaauaagucugaugugcuuggcccucgggggagugcugaucuucuuaucuacagcuguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10770 - RNA, 2308 nt, Artificial Sequence
  ZIKV (isolate Z1106033) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcaccauugguaaagccuuugaggcaacugugagaggcgcuaagaggauggccguacuaggggauacagcgugggacuucggauccgugggcggugcccucaauucucuggggaaaggcauccaccagaucuucggagcugcauuuaagucgcuuuucggcgggaugagcugguuuucccaaauuuugaucggaacccugcucauguggcugggccuuaacgccaaaaaugguucaauuagucugaugugcuuggcucucgggggaguucugauauucuuaucuacagccgucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10771 - RNA, 2296 nt, Artificial Sequence
  ZIKV (strain MR 766) prME-short variant mRNA Design 3 opt
gggagaaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcugggaggguucggcucccuuggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgauagguaaagcauucgaagccaccguccgcggcgcuaagagaauggccgugcuaggggacacugcaugggauuucggauccgugggcggugucuuuaauucucucgggaaaggcauucaccagaucuucggagcugccuuuaagucgcuguucggcgggaugagcugguuuucccaaauccuuauuggaacauugcugguuuggcucggccugaacaccaagaacgguucaaucagucuuacaugccuggcgcucgggggagugaugauuuucuugucuacugccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10772 - RNA, 2308 nt, Artificial Sequence
  ZIKV (strain NatalRGN) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgauugguaaagccuuugaggcaaccgugagaggcgcuaagaggauggccguacuaggggauacugcgugggacuucggauccgugggcggugcccucaauucucuggggaaaggcauccaccagaucuucggagcugcauuuaagucgcuuuucggcgggaugagcugguuuucccaaauuuugaucggaacacugcucauguggcugggccuuaacaccaaaaaugguucaauuagucugaugugcuuggcccucgggggaguucugauauucuuaucuacagcugucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10773 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggauauaguccucgaacaugguggcugugugaccgugauggcccaagacaagcccacagucgauauugaguuaguuacuaccacagugagcaacauggcagagguacgaucuuacugcuaugaggcuuccaucucagacauggccagcgauaguagauguccuacccagggggaagcguaccuggacaagcagucugacacgcaguaugugugcaaaaggacucuugucgaucggggauggggcaaugguuguggguuguucggaaagggcucccuggugacaugcgccaaauuugcaugcagcaagaaaaugaccggcaagucgauucaaccagaaaaccuagaguaccguaucaugcucucuguucacgggucccagcacucaggaaugaucgugaaugacacuggucaugaaacagaugagaaccgcgcuaaggucgagauuacccccaauaguccuagagccgaagcuacgcugggcggguucggaagccuuggccuggacugugagccaaggaccgguuuggauuuuuccgaccucuauuaccugacaaugaacaauaaacacugguuagugcauaaggaaugguuccacgauauaccgcugcccuggcacgccggggcagacacuggcaccccucauuggaacaauaaagaggcccucguagaauuuaaggaugcucacgcgaaacggcagacaguugugguccuuggaucucaggagggcgcagugcauacugcccuggcuggggccuuggaggcagaaauggacggagccaagggucgacuaagcucaggccaccugaaaugccgccucaagauggauaagcugagacuuaaaggggucaguuauucccuguguaccgcugccuucacauuuaccaagaucccagcagagacuuugcauggaacggugacaguugaagugcaauacgcgggcaccgacggucccugcaaaguaccugcucagauggccgucgacaugcagacucucaccccaguggggaggcugauuacagcaaaccccguuaucaccgagagcacugaaaacucuaagaugauguuagagcuggauccgccuuucggcgacucauacauagugauuggagucggcgagaaaaagaucacacaccacuggcaucggagugggagcacgcuaggaaaggccuucuccaccacucucaaaggugcucaacgccuggccgcacuuggcgauacagcuugggacuuugggucuaucggaggcguguucaauucgauugguagagccguacaccagguguuugggggcgcguucaggaccuuguuuggaggcaugagcuggaucacacaggggcugaugggagcccuccugcuuuggaugggcguuaacgcucgugaucgguccauugcacuggccuucuuggcuacuggugggguccucguguuucuggccaccaaugugcaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10774 - RNA, 2311 nt, Artificial Sequence
  ZIKV (isolate Z1106033) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacacgugugaugcaaccaugagcuacgagugcccaauguuagacgaaggaguagagccggaugacguggauuguuggugcaacacaacuuccaccugggucguguauggcacaugucaucacaaaaagggugaagcccgccgaucucguagagcuguuacccugcccucgcauucaacuaggaaacuacagacacggagccagaccuggcucgagagucgcgaguacacgaagcaccugauuagaguggaaaauuggaucuuuaggaacccuggguucgcacuugccgcugccgcgauagcauggcuguugggauccucuacuagccagaaagucaucuaucucgugaugauucugcugaucgccccagcuuacuccauucggugcaucggcguaucaaaucgcgacuuuguugagggcaugagugggggaaccuggguggaugucgugcucgaacaugguggcugugugacagucauggcccaagacaagcccacuguugauauagaguuagugaccacaaccguaagcaacauggcagaggugcgaucuuacugcuaugaggcuuccauuucagacauggccagcgauaguagauguccuacgcagggggaagcguaccuggacaagcagucugacacucaguaugucugcaaaaggacacuuguggaucggggauggggcaaugguuguggguuguucggaaagggcucccugguuaccugcgccaaauuugcaugcagcaagaaaaugacuggcaagucgauccaaccagaaaaccuagaguaccguauuaugcucucugugcacgggucccagcacucaggaaugaucgucaaugacacaggucaugaaaccgaugagaaccgcgcuaagguggagaucacgcccaauaguccuagagccgaagcuacccugggcggguucggaagccuuggccuggacugugagccaaggacagguuuggauuuuuccgaccucuauuaccugacuaugaacaauaaacacugguuaguacauaaggaaugguuccacgauauuccgcugcccuggcacgccggggcagacaccggcacaccucauuggaacaauaaagaggcccucguugaauuuaaggaugcucacgcgaaacggcagacuguggucgugcuuggaucucaggagggcgcaguccauaccgcccuggcuggggccuuggaggcagaaauggacggagccaagggucgacuaagcucaggccaccugaaaugccgccucaagauggauaagcugagacuuaaaggggugaguuauucccuguguacagcugccuucaccuuuacuaagauaccagcagagacguugcauggaacaguuaccguggaaguacaauacgcgggcacugacggucccugcaaagucccugcucagauggccguggacaugcagacccucacaccaguugggaggcugaucaccgcaaaccccgugauuacugagagcacagaaaacucuaagaugauguuagagcuggauccgccuuucggcgacucauacaucgucauaggagugggcgagaaaaagauuacgcaccacuggcaucggagugggagcacccuaggaaaggccuucuccacuacacucaaaggugcucaacgccuggccgcacuuggcgauaccgcuugggacuuugggucuaucggaggcguauucaauucgaucgguagagccgugcaccagguuuuugggggcgcguucaggacauuguuuggaggcaugagcuggauuacucaggggcugaugggagcccuccugcuuuggaugggcgucaacgcucgugaucgguccaucgcacuggccuucuuggcuaccgguggggugcucguguuucuggccacgaauguccaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10775 - RNA, 2299 nt, Artificial Sequence
  ZIKV (strain MR 766) prME-short variant mRNA Design 3 opt
gggagaaagcuuaccauggccaucagcggcgugcccguccugggguucuuuauuauagcuguucucauguccgcacaggagucuugggccaucaccagaaggggaucagcguacuauauguaccuugaccggagugaugcugguaaggccauuagcuucgcaacaacucugggcgugaacaaaugccacguacaaaucauggacuuggggcauaugugugaugccacgauguccuaugaaugcccuauguuagacgagggaguggaaccagaugacgucgauuguuggugcaauaccacaucuacuugggugguuuacggcaccugucaccauaagaaaggugaggcucgccgaucgcguagagcagugacacugccgucacacagcaccaggaagcuacagacucggagucagacauggcucgaaucccgcgaguauaccaaacaucugauuaaggucgagaacuggaucuuuagaaaucccggguucgcccuuguggcuguagccauagcguggcuguugggaucuagcacgucccagaagguuaucuaccucgugaugauucugcugaucgcacccgccuauucaauuaggugcaucggcgucaguaaccgggacuuuguggaaggcaugagcgggggaacuuggguggaugucguucucgagcacgguggcugugugaccguaauggcucaagacaaaccaacaguggauauagaauuagucacuaccacagugucuaauauggccgagguucgcuccuacugcuacgaggcaucaauuagcgacauggcuagugauucucgaugucccacccagggggaagccuaucuggacaagcaguccgacacgcaguacgugugcaaaagaacucuugucgauaggggauggggcaacgguuguggguuguucggaaagggcagccuggugacaugcgcgaaauuuaccugcucgaagaagaugacuggcaaaucuauccaaccugagaaucuagaauaucggauuaugcucuccguacacgggucacagcauaguggaaugaucgguuacgagacagacgaagaucgugccaagguugaggugaccccaaacagcccccgcgcagaggcuacgcugggcggguucggaucccuuggccuggacugugaaccuagaaccgguuuggauuuuucugaccucuauuaccugacaaugaauaacaaacacugguuaguccauaaggagugguuccacgauaucccacugccguggcacgccggggcugacacuggcaccccucauuggaauaacaaagaagcccucguggaguuuaaggaugcacacgccaaaaggcagacagucgugguucuuggaagccaggaaggcgcugugcauacugcgcuggcaggggccuuggaggcugagauggacggagccaagggucggcuauucucaggccaccugaagugccgacucaaaauggauaagcugcgccuuaaagggguaaguuauucccuguguaccgcagccuuuacauucaccaaggucccugcugaaacuuugcauggaacggugacaguugaggugcaauacgccggcaccgacgguccaugcaaaauucccguccagauggcaguggacaugcagacucucaccccuguagggagacugauaacagcgaauccagugaucaccgaaagcacugagaacucuaagaugauguuagaacuggaucccccguucggcgacucauacauuguuaucggagucggcgauaagaaaauaacacaccacuggcauaggagugggagcacgcuaggaaaggcuuuuuccaccacucucaaaggugcccaacggcuggcagcccuuggcgacacagcuugggauuucgggucuauuggaggcguguuuaauucgaucggucgcgccgugcaccaggucuucgggggcgcauuuagaaccuuguucggaggcaugagcuggaucacacaggggcugaugggagcucuccugcuuuggaugggcguuaacgccagggaccguuccauugcgcuggccuuuuuggcuacugguggggugcucguguuccuggcaaccaacguacaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10776 - RNA, 2311 nt, Artificial Sequence
  ZIKV (strain NatalRGN) prME-short variant mRNA Design 3 opt
gggagaaagcuuaccauggccaucagcggcgugcccguccugggguucuuuauuauagcuguucucauguccgcacaggagucuugggccgugaccagaaggggaucagcguacuauauguaccuugaccggaacgaugcuggugaagccaucaguuucccuacaacucugggcaugaauaagugcuauauucaaaucauggacuuggggcacaugugugaugcaacgaugagcuacgagugcccaauguuagacgaaggaguagagccggaugacguggauuguuggugcaacaccacauccacuugggucguguauggcaccugucaucacaaaaagggugaagcccgccgaucucguagagcuguuacacugcccucgcauucaaccaggaaacuacagacucggagccagacauggcucgagagucgcgaguacaccaagcaccugauuagaguggaaaauuggaucuuuaggaacccuggguucgcacuugccgcugccgcgauagcauggcuguugggauccucuacgagccagaaagucaucuaucucgugaugauucugcugaucgccccagcuuacuccauucggugcaucggcguaucaaaucgcgacuuuguugagggcaugagugggggaacuuggguggaugucgugcucgaacaugguggcugugugaccgucauggcccaagacaagcccacaguugauauagaguuagugacuaccacaguaagcaacauggcagaggugcgaucuuacugcuaugaggcuuccauuucagacauggccagcgauaguagauguccuacccagggggaagcguaccuggacaagcagucugacacgcaguaugucugcaaaaggacucuuguggaucggggauggggcaaugguuguggguuguucggaaagggcucccugguuacaugcgccaaauuugcaugcagcaagaaaaugaccggcaagucgauccaaccagaaaaccuagaguaccguauuaugcucucugugcacgggucccagcacucaggaaugaucgucaaugacacuggucaugaaacagaugagaaccgcgcuaagguggagaucacccccaauaguccuagagccgaagcuacgcugggcggguucggaagccuuggccuggacugugagccaaggaccgguuuggauuuuuccgaccucuauuaccugacaaugaacaauaaacacugguuaguacauaaggaaugguuccacgauauuccgcugcccuggcacgccggggcagacacuggcaccccucauuggaacaauaaagaggcccucguugaauuuaaggaugcucacgcgaaacggcagacaguggucgugcuuggaucucaggagggcgcaguccauacugcccuggcuggggccuuggaggcagaaauggacggagccaagggucgacuaagcucaggccaccugaaaugccgccucaagauggauaagcugagacuuaaaggggugaguuauucccuguguaccgcugccuucacauuuaccaagauaccagcagagacuuugcauggaacgguuacaguggaaguacaauacgcgggcaccgacggucccugcaaagucccugcucagauggccguggacaugcagacucucaccccaguugggaggcugaucacagcaaaccccgugauuaccgagagcacugaaaacucuaagaugauguuagagcuggauccgccuuucggcgacucauacaucgucauaggagugggcgagaaaaagauuacacaccacuggcaucggagugggagcacgcuaggaaaggccuucuccaccacucucaaaggugcucaacgccuggccgcacuuggcgauacagcuugggacuuugggucuaucggaggcguauucaauucgaucgguagagccgugcaccagguuuuugggggcgcguucaggaccuuguuuggaggcaugagcuggauuacacaggggcugaugggagcccuccugcuuuggaugggcgucaacgcucgugaucgguccaucgcacuggccuucuuggcuacugguggggugcucguguuucuggccaccaauguccaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10777 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacauugugcucgagcacgggggaugugucacugugauggcucaggauaagccaaccguggacaucgaauuagucacaaccacgguuucaaacauggccgaggugagaaguuacugcuaugaggcaagcauaucugauauggcuuccgacucaaggugucccacucaaggugaagccuaccuggacaagcagagcgauacacaguauguaugcaaacggacccuuguggaccguggcugggggaauggauguggcuuguuugguaaggggagucuggucacuugcgcgaaauucgccugcucuaagaaaaugacaggaaaguccauucagccugagaaccuagaauaccgcaucaugcucagcgugcacggcucgcaacauucuggcaugauuguuaaugauaccgggcacgagacggacgaaaacagagcaaagguggagaucaccccaaauucccccagggcugaggccacacugggagguuuuggcucacuugggcuggauugugaaccucggacuggauuggacuucagugaucucuauuaccugaccaugaacaauaaacauugguuaguccacaaggagugguuucacgacaucccacugccguggcaugcuggcgccgauacagguacuccccacuggaacaauaaagaagcacucguggaguucaaggacgcccaugcuaaacgacagaccguaguugugcuugggagccaggaaggcgcgguccacacagcacuggccggagcuuuggaggccgagauggauggcgcaaaggggcgccuauccucuggacaucugaaaugcagacucaagauggacaagcugaggcuuaaaggugugagcuauucacuguguaccgccgcuuuuacuuucacgaagauuccugccgaaacauugcacggcaccgucacuguggagguucaguacgcagggaccgacggaccaugcaaagugcccgcgcaaauggcuguagauaugcagacacucaccccugucggccggcugauaacugccaacccagugaucacagaaaguacggagaacuccaagaugauguuagaacuggacccuccguuuggugauagcuacauuguuaucggggugggcgagaaaaagauaacccaccauuggcaccgcucuggaucaacucuaggcaaggcauucaguacaacccucaaaggggcccagagacuggcugcccuuggagacacagcaugggauuucgguagcauuggcggggucuuuaauuccaucggaagggcugugcaucaaguauucggcggugccuuucguacuuuguucgggggcaugucuuggaucacccagggacugaugggcgcgcuccugcuuuggaugggggugaacgcccgggaccgaucgauugcucuggcauuuuuggccacgggaggcguucucgucuuccuggcuaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10778 - RNA, 2290 nt, Artificial Sequence
  ZIKV (isolate Z1106033) prME-short variant mRNA Design 3 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauacaugugacgccacuaugucauacgaaugcccuauguuagaugagggcguggaaccagacgauguagacuguuggugcaacaccacaaguaccuggguggucuaugggacuugucaccauaaaaagggagaggcacgacguagcagaagggccgugacacugccgucccacucuacccggaaacuacaaacgcgcucgcagacuuggcucgaaucaagagaguacaccaagcaucugauuaggguugagaauuggaucuuccggaaccccggcuuugcucuugcagccgcugccauugcguggcuguuggguagcaguacaucccagaaagugaucuaucucgucaugauacugcugaucgcacccgccuacucuauucgcugcaucggggugagcaaucgagauuucguagaaggaauguccggcggcacuuggguugacgugguccucgagcacgggggaugugugaccgugauggcucaggauaagccaacagucgacauugaauuaguuaccacgacugugucaaacauggccgagguaagaaguuacugcuaugaggcaagcaucucugauauggcuuccgacucaaggugucccacacaaggugaagccuaccuggacaagcagagcgauacccaguaugugugcaaacggacucuugucgaccguggcugggggaauggauguggcuuguuugguaaggggagucuggugacaugcgcgaaauucgccugcucuaagaaaaugaccggaaaguccauacagccugagaaccuagaauaccgcauuaugcucagcguucacggcucgcaacauucuggcaugaucgugaaugauacggggcacgagaccgacgaaaacagagcaaaggucgagauuacaccaaauucccccagggcugaggccacucugggagguuuuggcucacuugggcuggauugugaaccucggaccggauuggacuucagugaucucuauuaccugacaaugaacaauaaacauugguuagugcacaaggagugguuucacgacaucccacugccguggcaugcuggcgccgauacugguaccccucacuggaacaauaaagaagcacucguagaguucaaggacgcccaugcuaaacgacagacaguugugguccuugggagccaggaaggcgcggugcacaccgcacuggccggagcuuuggaggccgagauggauggcgcaaaggggcgccuauccucuggacaucugaaaugcagacucaagauggacaagcugaggcuuaaaggugucagcuauucacuguguacugccgcuuuuacguucacaaagaucccugccgaaaccuugcacggcacugugaccguugaggugcaguacgcagggacagacggaccaugcaaaguacccgcgcaaauggcugucgauaugcagacccucacuccugugggccggcugauuacagccaacccaguuauaacggaaaguaccgagaacuccaagaugauguuagaacuggaucccccguuuggugacagcuacaucgugauuggggucggcgagaaaaagaucacucaccauuggcaccgcucuggaucaacacuaggcaaggcauucaguaccacacucaaaggggcccagagacuggcugcccuuggagacacugcaugggauuucgguagcauaggcgggguguuuaauuccauuggaagggcuguacaucaaguguucggcggugccuuucguaccuuguucgggggcaugucuuggaucacgcagggacugaugggcgcgcuccugcuuuggauggggguuaacgcccgggaccgaucgaucgcucuggcauuuuuggccaccggaggcguccucguguuccuggcuacaaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10779 - RNA, 2278 nt, Artificial Sequence
  ZIKV (strain MR 766) prME-short variant mRNA Design 3 opt
gggagaaagcuuaccauggacuggaccuggauccuguuccucguggccgcugcaacaagaguccacagcauuacuaggcggggcuccgccuacuauauguaccuugaucgcucugacgcggggaaggcuauaucauuugccacgacccugggaguuaacaaaugccaugugcagaucauggauuugggucacaugugugacgcaacaaugaguuaugagugccccauguuagaugaaggcguagagccugacgauguggacuguuggugcaauacuaccagcacaugggucguguacgggaccugucaucacaagaaaggagaagcccgacguuccagaagggcuguuacucugccaucucauucgacacggaagcuacaaacccgcucacagacguggcucgagagcagagaauauacuaaacaccugauuaagguggagaacuggaucuucaggaauccgggcuuugcacuugucgccguggcuauugccuggcuguuggguaguuccaccucucagaagguaaucuaccucguuaugauacugcugaucgcgcccgcauauagcauucggugcaucgggguguccaaccgcgauuucgucgagggaaugucaggcggcacauggguggacgugguccucgaacacgggggauguguuacugugauggcccaggauaaaccuaccguagacauugaguuagugacaaccacggucaguaauauggcugaagugcgaagcuacugcuacgaggccucuaucuccgauauggcaucagacagcagauguccaacucaaggugaggcuuaucuggacaagcagagugauacacaguacguuugcaaaaggacccuuguggaccggggcugggggaacggauguggcuuguuugguaaggggucucuggucacuugcgccaaauucacaugcuccaagaagaugaccggaaaaagcauacagcccgaaaaucuagaguaucguauuaugcucucggugcauggcucucaacacuccggcaugaucggguacgaaacggaugaggaccgcgcgaagguagaaguuaccccuaacucaccaagagccgaggcaacacugggagguuuuggcagucuugggcuggauugugagcccaggacuggauuggacuucagcgaucucuauuaccugaccaugaauaacaaacauugguuagugcacaaggaaugguuucacgacauuccucugccauggcaugcuggcgccgauacagguacuccgcacuggaauaacaaagaggcucucgucgaguucaaggacgcccaugcaaaacggcagaccguggucgugcuugggucccaggaaggcgccguucacacagcucuggcgggagcauuggaagccgagauggauggcgcuaaggggcgacuauuuucuggacaucugaagugccgccucaaaauggacaagcugagacuuaaaggugugagcuauucacuguguaccgccgcauucacuuuuacgaagguacccgccgagacauugcacggcaccgucacuguggaaguucaguacgcugggaccgacggaccuugcaaaaucccagugcaaauggccgucgauaugcagacacucacccccgugggcaggcugaucacugcaaauccuguaauuacagagaguacggaaaacuccaagaugauguuagagcuggacccacccuucggugauagcuacauagugaucgggguuggcgacaagaaaauuacccaccauuggcaccggucuggaucaacucuaggcaaggcguucaguacaacccucaaaggggcucagcgccuggccgcacuuggagauacagccugggacuuugguagcaucggcggggucuucaauuccauaggcagagcugugcaucaaguguuuggaggugccuucaggacuuuguuugggggcaugucuuggauuacccagggacugaugggcgcacuccugcuuuggaugggggucaacgcucgugaucggucgaucgcccuggcguucuuggccacgggaggcguucucguguuucuggcuaccaacgugcacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10780 - RNA, 2290 nt, Artificial Sequence
  ZIKV (strain NatalRGN) prME-short variant mRNA Design 3 opt
gggagaaagcuuaccauggacuggaccuggauccuguuccucguggccgcugcaacaagaguccacagcguuacuaggcggggcuccgccuacuauauguaccuugaucgcaacgacgcgggggaggcuauuucuuuucccacgacccugggaaugaauaagugcuauauacagaucauggauuugggucauaugugugacgccacaaugucauacgaaugcccuauguuagaugagggcguggaaccagacgauguagacuguuggugcaacacuaccaguacauggguggucuaugggaccugucaccauaaaaagggagaggcacgacguagcagaagggccgugacucugccgucccacucuacacggaaacuacaaacccgcucgcagacguggcucgaaucaagagaguacacuaagcaucugauuaggguugagaauuggaucuuccggaaccccggcuuugcucuugcagccgcugccauugcguggcuguuggguagcaguaccucccagaaagugaucuaucucgucaugauacugcugaucgcacccgccuacucuauucgcugcaucggggugagcaaucgagauuucguagaaggaauguccggcggcacauggguugacgugguccucgagcacgggggaugugugacugugauggcucaggauaagccaaccgucgacauugaauuaguuacaaccacggugucaaacauggccgagguaagaaguuacugcuaugaggcaagcaucucugauauggcuuccgacucaaggugucccacucaaggugaagccuaccuggacaagcagagcgauacacaguaugugugcaaacggacccuugucgaccguggcugggggaauggauguggcuuguuugguaaggggagucuggugacuugcgcgaaauucgccugcucuaagaaaaugacaggaaaguccauacagccugagaaccuagaauaccgcauuaugcucagcguucacggcucgcaacauucuggcaugaucgugaaugauaccgggcacgagacggacgaaaacagagcaaaggucgagauuaccccaaauucccccagggcugaggccacacugggagguuuuggcucacuugggcuggauugugaaccucggacuggauuggacuucagugaucucuauuaccugaccaugaacaauaaacauugguuagugcacaaggagugguuucacgacaucccacugccguggcaugcuggcgccgauacagguacuccccacuggaacaauaaagaagcacucguagaguucaaggacgcccaugcuaaacgacagaccguugugguccuugggagccaggaaggcgcggugcacacagcacuggccggagcuuuggaggccgagauggauggcgcaaaggggcgccuauccucuggacaucugaaaugcagacucaagauggacaagcugaggcuuaaaggugucagcuauucacuguguaccgccgcuuuuacuuucacgaagaucccugccgaaacauugcacggcaccgugacuguugaggugcaguacgcagggaccgacggaccaugcaaaguacccgcgcaaauggcugucgauaugcagacacucaccccugugggccggcugauuacugccaacccaguuauaacagaaaguacggagaacuccaagaugauguuagaacuggacccuccguuuggugauagcuacaucgugauuggggucggcgagaaaaagaucacccaccauuggcaccgcucuggaucaacucuaggcaaggcauucaguacaacccucaaaggggcccagagacuggcugcccuuggagacacagcaugggauuucgguagcauaggcgggguguuuaauuccauuggaagggcuguacaucaaguguucggcggugccuuucguacuuuguucgggggcaugucuuggaucacccagggacugaugggcgcgcuccugcuuuggauggggguuaacgcccgggaccgaucgaucgcucuggcauuuuuggccacgggaggcguccucguguuccuggcuaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10781 - RNA, 2308 nt, Artificial Sequence
  ZIKV (strain ZikaSPH2015) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugauaucgugcucgagcauggcgggugcgucaccgugauggcucaggacaagccaacaguggauauagaauuagucacuaccacaguuagcaacauggccgaggugagaucuuacuguuaugaggcguccauuucagacauggccagcgauaguaggugccccacccaaggagaagcauaccuggacaaacagucugacacgcaguauguauguaagcggacucuuguggaucguggcugggguaaugggugcggauuguucggcaaaggcucccuggucacaugcgcuaaguuugccuguagcaaaaagaugaccgggaagucgauccagccugagaaccuagaauaccgcauuaugcucucugugcacggaucccaacacucagguaugaucguuaaugacacuggccaugagacagaugaaaacagagcuaaaguggagaucaccccaaauagucccagggccgaggcaacgcuugggggauucggcagccugggucuggacugcgaaccucggaccggguuggauuuuuccgaccucuauuaccugacaaugaacaauaagcacugguuaguccauaaagagugguuccacgauauuccacugccguggcacgccggcgcugacacuggaacaccccauuggaacaauaaggaagcgcucguggaguuuaaagaugcacacgccaagcgacagaccguaguugugcuuggcucucaggaaggggcuguccauacugcccuggcaggagccuuggaggcugagauggacggugccaaaggccgccuaagcucagggcaccugaaguguagacucaagauggauaaacugaggcuuaagggagugaguuauucccugugcaccgcagcguucacauuuaccaaaauaccugcugaaacuuugcauggcacggucacaguggagguucaguacgccgguaccgacgggccauguaaggugcccgcacaaauggccguagacaugcagacucucaccccugucggccggcugaucacagcuaacccagugauuaccgaaagcacugagaacucuaaaaugauguuagaacuggaucccccguucggagacucauacaucguuauaggcgugggggagaagaagauuacacaccacuggcaucgcaguggaagcacgcuagguaaagccuuuuccaccacucucaagggcgcacagagacuggcugcccuuggggauacagcgugggacuucggaucuaucggcggugucuucaauucgaucgggagggccgugcaccaaguauuuggcggagcuuuccguaccuuguuuggcgggaugagcuggauuacacagggacugaugggcgcacuccugcuuuggaugggugugaacgcccgggaucgauccaucgcucuggccuucuuggcaacugggggaguucucgucuuucuggcgaccaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10782 - RNA, 2308 nt, Artificial Sequence
  ZIKV (isolate Z1106033) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacacgugcgaugcuaccaugagcuacgaauguccuauguuagacgagggcguggaaccagaugacguagauugcugguguaacacaacuuccaccuggguggucuaugguacaugccaucacaagaaaggggaggcacgacguucuagaagggccgugacccugccgucgcauucaacucggaagcuacaaacacgcagccagaccuggcucgaaaguagagaguacacgaaacaccugaucaggguugagaauuggauuuuucggaaccccggauucgcucuugccgcggcagccaucgcuuggcuguugggcuccucuacuagccagaaggugauauaucucgucaugauccugcugauugccccugcauacuccauccgcuguauuggcgugucaaaucgagacuuuguagaagggaugaguggagguaccuggguugaugugguccucgagcauggcgggugcgugacagugauggcucaggacaagccaacugucgauaucgaauuaguuaccacaaccgugagcaacauggccgagguaagaucuuacuguuaugaggcguccauaucagacauggccagcgauaguaggugccccacgcaaggagaagcauaccuggacaaacagucugacacucaguauguguguaagcggacacuugucgaucguggcugggguaaugggugcggauuguucggcaaaggcucccuggugaccugcgcuaaguuugccuguagcaaaaagaugacugggaagucgauucagccugagaaccuagaauaccgcaucaugcucucuguucacggaucccaacacucagguaugauugugaaugacacaggccaugagaccgaugaaaacagagcuaaagucgagaucacgccaaauagucccagggccgaggcaacccuugggggauucggcagccugggucuggacugcgaaccucggacaggguuggauuuuuccgaccucuauuaccugacuaugaacaauaagcacugguuagugcauaaagagugguuccacgauaucccacugccguggcacgccggcgcugacaccggaacaccccauuggaacaauaaggaagcgcucguagaguuuaaagaugcacacgccaagcgacagacuguugugguccuuggcucucaggaaggggcugugcauaccgcccuggcaggagccuuggaggcugagauggacggugccaaaggccgccuaagcucagggcaccugaaguguagacucaagauggauaaacugaggcuuaagggagucaguuauucccugugcacagcagcguucaccuuuacuaaaauuccugcugaaacguugcauggcacagugaccguugaggugcaguacgccgguacugacgggccauguaagguacccgcacaaauggccgucgacaugcagacccucacaccugugggccggcugauaaccgcuaacccaguuaucacugaaagcacagagaacucuaaaaugauguuagaacuggaucccccguucggagacucauacauugugaucggcgucggggagaagaagauaacgcaccacuggcaucgcaguggaagcacccuagguaaagccuuuuccacuacacucaagggcgcacagagacuggcugcccuuggggauaccgcgugggacuucggaucuauuggcgguguguucaauucgaucgggagggccguacaccaaguguuuggcggagcuuuccguacauuguuuggcgggaugagcuggaucacucagggacugaugggcgcacuccugcuuuggauggguguuaacgcccgggaucgauccauugcucuggccuucuuggcaaccgggggaguccucguguuucuggcgacgaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10783 - RNA, 2296 nt, Artificial Sequence
  ZIKV (strain MR 766) prME-short variant mRNA Design 3 opt
gggagaaagcuuaccaugggcaagagaagcgccggguccaucauguggcuggcuucucucgcaguggucauugccugcgcgggagcuauaaccaggcgggguucagccuacuauauguaccuugaccgcagugaugcaggcaaagccaucagcuucgcuacaacucuggggguuaacaagugucacgugcagauuauggacuugggacauaugugcgaugcaacgauguccuaugagugucccauguuagacgaaggcguagagccugaugacguggauugcugguguaauaccacaucuacuugggucguguacgguaccugccaccauaaaaagggggaagcccgacguucgagaagggcuguuacacugccaucacacagcacccggaaacuacaaacucgcagucagacauggcucgaguccagagaauauaccaagcaucugaucaagguggagaacuggauuuuuaggaauccgggauucgcccuugucgcgguggcaaucgccuggcuguugggcucuagcacgucccagaaaguaauauaccucguuaugauccugcugauugcucccgccuauucaauccgguguauuggcgugaguaaccgcgacuuugucgaggggaugagcggagguacuuggguggaugugguccucgaacacggcgggugcguuaccgugauggcacaggacaagccuacaguagauaucgaguuagugacuaccacagucucuaauauggcugaagugcgauccuacuguuacgaggccucaauaagcgacauggcgagugauucuagaugcccaacccaaggagaggccuaucuggacaaacaguccgacacgcaguacguuuguaagaggacucuuguggaucggggcugggguaacgggugcggauuguucggcaaaggcagccuggucacaugcgcaaaguuuaccuguucgaagaaaaugacugggaagucuauucagcccgaaaaucuagaguaucguaucaugcucuccgugcacggaucacaacauagugguaugauuggcuacgaaacagacgaggaucgcgcuaaaguagaaguuaccccuaacagcccaagagccgaggcuacgcuugggggauucggcucccugggucuggacugcgagcccaggaccggguuggauuuuucugaccucuauuaccugacaaugaauaacaagcacugguuagugcauaaagaaugguuccacgauaucccucugccauggcacgccggcgcagacacuggaaccccgcauuggaauaacaaggaggcccucgucgaauuuaaagaugcucacgcgaagcggcagacaguggucgugcuuggcagccaggagggggcaguucauacugcccuggcuggagccuuggaagcagagauggacggugccaagggccgacuauucucagggcaccugaaaugucgccucaagauggauaaacugagacuuaagggagugaguuauucccugugcaccgcugccuuuacauucaccaaaguacccgcagagacuuugcauggcacggucacaguggaaguucaguacgcggguaccgacgggccuuguaagaucccagugcaaauggcugucgacaugcagacucucacccccgugggcaggcugauuacagccaauccuguaauaaccgagagcacugaaaacucuaagaugauguuagagcuggauccacccuuuggagacucauacaucgugauuggcguuggggauaaaaagaucacacaccacuggcaucggaguggaagcacgcuagguaaagcauucuccaccacucucaagggcgcccagcgccuggcugcccuuggggacacagcaugggauuucggaucuauaggcggugucuuuaauucgauugggagagcugugcaccaaguguucggcggagccuuuaggaccuuguucggcgggaugagcuggaucacacagggacugaugggcgcgcuccugcuuuggaugggugucaacgcccgugaccgguccaucgcucuggcauuuuuggccacugggggaguucucguguuccuggcuaccaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10784 - RNA, 2308 nt, Artificial Sequence
  ZIKV (strain NatalRGN) prME-short variant mRNA Design 3 opt
gggagaaagcuuaccaugggcaagagaagcgccggguccaucauguggcuggcuucucucgcaguggucauugccugcgcgggagcuguuaccaggcgggguucagccuacuauauguaccuugaccgcaacgaugcaggcgaggccauaaguuuccccacaacucuggggaugaauaaauguuauauccagauuauggacuugggacacaugugcgaugcuacgaugagcuacgaauguccuauguuagacgagggcguggaaccagaugacguagauugcugguguaacaccacauccacuuggguggucuaugguaccugccaucacaagaaaggggaggcacgacguucuagaagggccgugacacugccgucgcauucaacccggaagcuacaaacucgcagccagacauggcucgaaaguagagaguacaccaaacaccugaucaggguugagaauuggauuuuucggaaccccggauucgcucuugccgcggcagccaucgcuuggcuguugggcuccucuacgagccagaaggugauauaucucgucaugauccugcugauugccccugcauacuccauccgcuguauuggcgugucaaaucgagacuuuguagaagggaugaguggagguacuuggguugaugugguccucgagcauggcgggugcgugaccgugauggcucaggacaagccaacagucgauaucgaauuaguuacuaccacagugagcaacauggccgagguaagaucuuacuguuaugaggcguccauaucagacauggccagcgauaguaggugccccacccaaggagaagcauaccuggacaaacagucugacacgcaguauguguguaagcggacucuugucgaucguggcugggguaaugggugcggauuguucggcaaaggcucccuggugacaugcgcuaaguuugccuguagcaaaaagaugaccgggaagucgauucagccugagaaccuagaauaccgcaucaugcucucuguucacggaucccaacacucagguaugauugugaaugacacuggccaugagacagaugaaaacagagcuaaagucgagaucaccccaaauagucccagggccgaggcaacgcuugggggauucggcagccugggucuggacugcgaaccucggaccggguuggauuuuuccgaccucuauuaccugacaaugaacaauaagcacugguuagugcauaaagagugguuccacgauaucccacugccguggcacgccggcgcugacacuggaacaccccauuggaacaauaaggaagcgcucguagaguuuaaagaugcacacgccaagcgacagaccguugugguccuuggcucucaggaaggggcugugcauacugcccuggcaggagccuuggaggcugagauggacggugccaaaggccgccuaagcucagggcaccugaaguguagacucaagauggauaaacugaggcuuaagggagucaguuauucccugugcaccgcagcguucacauuuaccaaaauuccugcugaaacuuugcauggcacggugacaguugaggugcaguacgccgguaccgacgggccauguaagguacccgcacaaauggccgucgacaugcagacucucaccccugugggccggcugauaacagcuaacccaguuaucaccgaaagcacugagaacucuaaaaugauguuagaacuggaucccccguucggagacucauacauugugaucggcgucggggagaagaagauaacacaccacuggcaucgcaguggaagcacgcuagguaaagccuuuuccaccacucucaagggcgcacagagacuggcugcccuuggggauacagcgugggacuucggaucuauuggcgguguguucaauucgaucgggagggccguacaccaaguguuuggcggagcuuuccguaccuuguuuggcgggaugagcuggaucacacagggacugaugggcgcacuccugcuuuggauggguguuaacgcccgggaucgauccauugcucuggccuucuuggcaacugggggaguccucguguuucuggcgaccaaugugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10785 - RNA, 2011 nt, Artificial Sequence
  ZIKV (strain ZikaSPH2015) ME variant mRNA Design 3 opt
gggagaaagcuuaccaugaccagcgugggcauugucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugauaucgugcucgagcacggugggugugucacugugauggcccaggacaaaccgacaguagauauugaacugguuaccacgacugugaguaauauggcugaggucagguccuauugcuacgaggccucuaucagcgacauggcguccgauucacggugucccacccagggagaagcauaucuggacaagcaaagugauacacaguacgugugcaaacgcacucucguggacagaggcuggggcaacggguguggauuauuugguaagggcagccuggucacaugcgccaaguucgcuuguucuaaaaagaugacagggaaauccauucagccugagaaucuugaauauaggaucauguugucaguucauggaagccagcacaguggcaugauagugaacgauaccggucaugagacggacgagaaucgggccaagguagaaauuacuccaaacucuccccgcgcagaggcuacacuagggggauuuggcucccugggccucgauugcgaaccucgaaccgggcuggacuucagcgaucuuuacuaccugacuaugaauaacaaacacugguuggugcacaaggagugguuucaugacaucccacuccccuggcacgccggagcggacacagguaccccucauuggaauaacaaggaagcccuggucgaguucaaagaugcacacgcuaagagacaaacggugguuguguuaggcucgcaggagggggccguccacaccgcucuggccggagcacucgaagccgagauggacggcgcuaaagguaggcuuucuuccgggcaucugaagugucgguugaaaauggauaagcuacgucugaaaggcgugucauauagucucugcacagcggcauuuacuuucaccaagauuccagccgaaacacugcacggaacuguaaccguugaggugcaguacgcuggcacagacgggccguguaagguccccgcccagauggcaguggauaugcaaacccuuacuccugucggacgccugaucacggccaauccagugaucacagaaagcaccgagaacuccaaaaugauguuggagcucgaucccccuuuuggugacucuuauauuguuauaggcgugggggaaaagaaaaucacucaucacuggcauagaagcggaucaaccauuggcaaggcuuucgaggccacaguaaggggugcaaaacggauggcgguccugggggacaccgcuugggauuuuggcagugugggaggcgccuuaaauucccuggggaagggaauccaccagauauucggugcagccuucaagagccuauuuggcgggaugucuugguucucacagauucucaucggaacucugcuuaugugguugggccugaacaccaaaaacgguaguaucagccucaugugccuggcucuugggggcguucugaucuuuuuguccacggccgugucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10786 - RNA, 2011 nt, Artificial Sequence
  ZIKV (isolate Z1106033) ME variant mRNA Design 3 opt
gggagaaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacgcuaaaaacgguaguaucagccucaugugccuggcccuugggggcgugcugaucuuuuuguccacagcagucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10787 - RNA, 1999 nt, Artificial Sequence
  ZIKV (strain MR 766) ME variant mRNA Design 3 opt
gggagaaagcuuaccaugaccagcaucggcauuauagggcugcuccuuacaacugccauggcugcagugacgcugcccucccacucuaccagaaaguugcagacaaggucacaaacuugguuagagagucgggaauacaccaaacaucugaucaaggucgagaacuggauuuuccgcaauccuggauuugcccuaguugcgguggcuaucgccuggcuccuggguagcuccacaucucagaaaguaauuuaucuugugaugauccuguugauagcaccagccuacucgauccgaugcauuggcgucucaaaccgugacuucguggaagggaugagcggaggcaccuggguugaugugguccucgagcacggugggugugugacuguaauggcucaggacaagccgacaguugauaucgaacuggugaccacgacugucaguaauauggcagaggugagauccuauugcuacgaggccucuauuagcgacauggcuuccgauucaaggugucccacccagggagaagccuaucuggacaaacaaagugauacacaguacgugugcaagcggacucucgucgaccgcggcuggggcaacggguguggauuauuugguaagggcagccugguuaccugcgcgaaauucacauguucuaagaaaaugaccgggaaguccauccagccugagaaucuugaauauagaauaauguugucagugcauggaagccagcacaguggcaugauugguuacgagacggaugaggacagggcaaaaguagaagugacuccaaacucuccccgggccgaggcuacacuugggggauuuggcucccuaggccucgauugcgaaccucgcaccgggcuggacuucagcgaucuuuacuaucugacuaugaauaacaagcauugguugguccacaaggagugguuucacgacaucccacuccccuggcaugccggagcagacacagguaccccucacuggaauaacaaagaagcucugguggaguucaaggaugcccaugcgaaacgacaaacgguuguggucuuaggcucgcaggagggggccgugcacaccgcacuggcuggagcccucgaagcugagauggacggcgccaaggguagacuguuuucugggcaccugaaauguagguugaagauggauaaacuacggcugaagggcguauccuacucacucugcacagcagccuucacuuuuaccaagguuccagcugaaacacugcauggaacugugaccgucgaggugcaguaugcgggcacagacgggccguguaaaauucccguccagauggcaguggauaugcaaacccuuacuccuguuggacgucugaucacggccaauccagugaucacagaaaguaccgagaacagcaagaugauguuggagcucgaucccccuuucggugacuccuacauuguaauaggcgucggggacaaaaagaucacucaccauuggcaccgcucuggaagcaccauuggcaaggcuuuugaagccacagugagaggugcaaaaaggauggccguucugggggauaccgcuugggacuucggcucagugggaggcgucuucaauaguuuagggaagggaauccaucagauauuuggugccgcauucaaaucccuguuuggcgggaugagcugguucucucagauucuaaucggaacucuccugguguggcuuggcuugaacacaaagaaugguucaaucagucugacgugccucgcgcuugggggcguaaugauuuuucugagcaccgcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10788 - RNA, 2011 nt, Artificial Sequence
  ZIKV (strain NatalRGN) ME variant mRNA Design 3 opt
gggagaaagcuuaccaugaccagcgugggcaucgucgggcugcuccuuacaacugccauggcugcaguuacgcugcccucccacucuaccagaaaguugcagacaaggucacaaacuugguuagagagucgggaauacaccaaacaucugauucgcguggagaacuggauauuccgaaauccuggauuugcccuagcggcugccgcaaucgccuggcuccuggguagcuccacaucucagaagguaauuuaucuugugaugauccuguugauugcuccagcauacucgauccguugcauaggcgucucaaacagagacuucguggaagggaugagcggaggcaccuggguugaugugguccucgagcacggugggugugugacuguaauggcccaggacaaaccgacaguugauaucgaacuggugaccacgacugucaguaauauggcugaggugagguccuauugcuacgaggccucuauuagcgacauggcguccgauucacggugucccacccagggagaagcauaucuggacaagcaaagugauacacaguacgugugcaaacgcacucucgucgacagaggcuggggcaacggguguggauuauuugguaagggcagccugguuaccugcgccaaguucgcuuguucuaaaaagaugacagggaaauccauccagccugagaaucuugaauauaggauuauguugucagugcauggaagccagcacaguggcaugaucguaaacgauaccggucaugagacggacgagaaucgggccaagguggaaauaacuccaaacucuccccgcgcagaggcuacacugggaggauuuggcucccuaggccucgauugcgaaccucgaaccgggcuggacuucagcgaucuuuacuaccugacuaugaauaacaaacacugguugguccacaaggagugguuucaugacauuccacuccccuggcacgccggagcggacacagguaccccucauuggaauaacaaggaagcccugguggaguucaaagaugcacacgcuaagagacaaacgguuguggucuuaggcucgcaggagggggccgugcacaccgcucuggccggagcacucgaagccgagauggacggcgcuaaagguaggcuuucuuccgggcaucugaagugucgguugaaaauggauaagcuacgucugaaaggcguaucauauagucucugcacagcggcauuuacuuucaccaagaucccagccgaaacacugcacggaacuguuaccguggagguccaguacgcuggcacagacgggccguguaaggugcccgcccagauggcagucgauaugcaaacccuuacuccugugggacgccugauuacggccaauccaguuaucacagaaagcaccgagaacuccaaaaugauguuggagcucgaucccccuuuuggugacucuuauaucgugauuggcguaggggaaaagaaaauaacucaucacuggcauagaagcggaucaaccaucggcaaggcuuucgaggccacagucaggggugcaaaacggauggcggugcugggggacaccgcuugggauuuuggcaguguuggaggcgccuuaaauucccuggggaaggggauucaccagaucuucggugcagccuucaagagccuauuuggcgggaugucuugguucucacagauacucauuggaacucugcuuaugugguugggccugaacacgaaaaacgguaguaucagccucaugugccuggcucuugggggcgugcugaucuuuuuguccacagccgucucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10789 - RNA, 2038 nt, Artificial Sequence
  ZIKV (strain ZikaSPH2015) ME variant mRNA Design 3 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggauaucgucuuggaacacggugggugugugaccguaauggcccaggacaaacccacaguugauauugagcucgugaccacuacagucucuaauauggcggaggugaggagcuauugcuacgaagcauccaucucagacauggccagugauagccgguguccuacccaaggagaggcuuaucuggacaagcagucugauacgcaguacgugugcaaacgcacucuggucgacagaggcuggggcaacggguguggacucuuugguaagggcuccuuaguuaccugcgccaaguucgcauguagcaaaaagaugacagggaaaucaauacagccagaaaaucuggaguauaggauuaugcuuagugugcauggaucucaacacuccggcaugaucguaaacgauacuggucaugagaccgacgaaaaucgggcuaagguggagauuacacccaacagcccucgcgccgaagcgaccuugggaggauuuggcucgcugggccuagauugcgagccacgaacggggcucgacuucucugaucuguacuaccuuacuaugaauaacaaacacuggcugguccacaaggaaugguuucaugacauccccuugccuuggcacgccggagcagacacagguaccccacauuggaauaacaaggaggcucucguggaguucaaagaugcccacgcuaagagacagacuguugugguccugggcucccaggaaggggccgugcacacagcauuagccggagcucuggaggcggaaauggacggcgcaaaagguaggcucucaagugggcaucuuaagugucggcugaaaauggauaaguugcgucuaaaaggcguaagcuauucccugugcaccgccgcuuuuacguucaccaagaucccggccgagacacuccacggaacuguuaccguggaaguccaguacgcaggcacagacgggcccuguaaggugccugcccaaauggcugucgauaugcagacucugaccccagugggacgccuuauuacagccaaucccguuauaaccgagucuacugagaacagcaaaaugaugcuggaauuggacccuccauuuggugauucauauaucgugauuggcguaggggagaagaaaaucacgcaucacuggcauagaaguggauccacaauaggcaaggcauucgaagcgaccgucaggggugcuaaacggauggccgugcucggggacacugcaugggauuucggcagcguuggaggcgccuuaaauucucuggggaaggggauucaccagaucuuuggugcugccuucaagucacuguuuggcgggaugaguugguucagccaaauccuaauuggaacccuccugauguggcuuggcuugaacaccaaaaacgguuccaucucucugaugugccucgcacuugggggcgugcugauuuuucugucgacagcugucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10790 - RNA, 2038 nt, Artificial Sequence
  ZIKV (isolate Z1106033) ME variant mRNA Design 3 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacgcuaaaaacgguuccauuucucugaugugccucgcacuugggggcguccugaucuuucugucgacagccgugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10791 - RNA, 2026 nt, Artificial Sequence
  ZIKV (strain MR 766) ME variant mRNA Design 3 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaaucaagguagaaaacuggauuuuccgcaauccaggauuugcucugguggccgucgcaaucgccuggcuacucgguucuucgacaucacagaaagugauuuaucugguuaugauccuucugauagcuccggcauacagcauccgaugcauuggcgugaguaaccgugacuucgucgaggggauguccggaggcacuuggguggauguaguuuuggaacacggugggugugugaccgucauggcccaggacaagcccacaguggauaucgagcucgugaccacuacagucucuaauauggcugagguuagaagcuauugcuacgaagccuccauuucagacauggcgagugauucuagguguccuacccaaggagaggcauaucuggacaaacagagcgauacgcaguacgugugcaagcggacucugguagaccgcggcuggggcaacggguguggacucuuugguaagggcuccuuagugaccugcgccaaauucacauguucaaagaaaaugacuggaaagagcauccagccagaaaaucuggaguauagaauaaugcuuaguguccaugggucucaacacuccggcaugauugguuacgagaccgaugaagacagggcuaaaguggagguuacacccaacagcccucgggccgaagcaaccuugggaggguuuggcucgcugggccuagauugcgagccacgcacggggcucgacuucucugaucuguacuaucuuacuaugaauaacaagcauuggcuggugcacaaggaaugguuucacgacauccccuugccuuggcaugcuggagccgacacagguaccccacacuggaauaacaaagaggcgcucgucgaguucaaggaugcccaugcaaaacgacagacugugguaguucugggcucccaggaaggggcugugcacacagccuuagcuggagcccuggaggcagaaauggacggcgccaaggguagacucuuuucagggcaccuuaaauguaggcugaagauggauaaauugcggcuaaagggcgucaguuacagccugugcaccgcugcguucacguuuaccaaggugccggcagagacacuccauggaacugucaccguggaaguucaguaugccggcacagacgggcccuguaaaauuccugugcaaauggcuguagauaugcagacucugaccccagucggacgucuuaucacagccaaucccgugaucaccgaguccacugagaacucuaagaugaugcuggaauuggacccuccauucggugauagcuacauuguuauaggcgugggggacaaaaagaucacgcaccauuggcaccgcucaggaaguacaauuggcaaagcauucgaggccaccgucagaggugcuaagaggauggccgugcucggggauacugcaugggacuuuggcuccguaggaggcguguucaauagccuggggaagggaauccaucagauauuuggugcggcuuucaaaucuuuauuuggcgggaugucaugguucagucaaauucugaucggaacccuacucguuuggcugggccuuaacacaaagaaugguagcaucuccuugaccugccuggcccucgggggcgucaugauuuuucugucuacugcagugucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10792 - RNA, 2038 nt, Artificial Sequence
  ZIKV (strain NatalRGN) ME variant mRNA Design 3 opt
gggagaaagcuuaccauggccaucagcggcgugcccguccugggguucuuuauuauagcuguucucauguccgcacaggagucuugggccgcggugacccuuccuucacacaguacaagaaagcugcaaacuaggagccagacgugguuggaaucccgggaguacaccaaacauuuaauccgcguagaaaacuggauuuuccgaaauccaggauuugcucuggccgcagccgcuaucgcauggcuacucgguucuucgacaucacagaaggugauuuaucuggucaugauccuucugauagccccggcuuacagcauccguugcauuggcgugaguaacagagacuucguugaggggauguccggaggcacuuggguggaugucguguuggaacacgguggguguguaaccguuauggcccaggacaaacccacaguggauaucgagcucgucaccacuacagugucuaauauggcggaggugaggagcuauugcuacgaagcauccauuucagacauggccagugauagccgguguccuacccaaggagaggcuuaucuggacaagcagucugauacgcaguacgucugcaaacgcacucugguugacagaggcuggggcaacggguguggacucuuugguaagggcuccuuagugaccugcgccaaguucgcauguagcaaaaagaugacagggaaaucaauccagccagaaaaucuggaguauaggauaaugcuuaguguacauggaucucaacacuccggcaugauugugaacgauacuggucaugagaccgacgaaaaucgggcuaaggucgagaucacacccaacagcccucgcgccgaagcgaccuugggaggguuuggcucgcugggccuagauugcgagccacgaacggggcucgacuucucugaucuguacuaccuuacuaugaauaacaaacacuggcuggugcacaaggaaugguuucaugacauucccuugccuuggcacgccggagcagacacagguaccccacauuggaauaacaaggaggcucucguugaguucaaagaugcccacgcuaagagacagacuguggucgugcugggcucccaggaaggggccguacacacagcauuagccggagcucuggaggcggaaauggacggcgcaaaagguaggcucucaagugggcaucuuaagugucggcugaaaauggauaaguugcgucuaaaaggcguuagcuauucccugugcaccgccgcuuuuacguucaccaagaucccggccgagacacuccacggaacugugaccgucgaagugcaguacgcaggcacagacgggcccuguaaggucccugcccaaauggcuguggauaugcagacucugaccccaguuggacgccuuaucacagccaaucccgugauuaccgagucuacugagaacagcaaaaugaugcuggaauuggacccuccauuuggugauucauauauaguaaucggcgucggggagaagaaaauuacgcaucacuggcauagaaguggauccacaaucggcaaggcauucgaagcgaccgugaggggugcuaaacggauggccguucucggggacacugcaugggauuucggcagcgugggaggcgccuuaaauucucuggggaagggaauacaccagauuuuuggugcugccuucaagucacuguuuggcgggaugaguugguucagccaaauccuaaucggaacccuccugauguggcuuggcuugaacaccaaaaacgguuccauuucucugaugugccucgcacuugggggcguccugaucuuucugucgacagcugugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10793 - RNA, 2017 nt, Artificial Sequence
  ZIKV (strain ZikaSPH2015) ME variant mRNA Design 3 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacaucguguuggagcauggaggcugugucaccgugauggcucaggauaaaccgacuguagacauugaacucguuacaaccacggugaguaauauggccgagguccgguccuauugcuacgaggcgucuaucagcgauauggcauccgacucacgcugucccacucagggugaagccuaucuggauaagcaaagugacacccaguacgugugcaaaagaacacugguggauaggggguggggaaacggcuguggccucuucgggaaggggagcuuagucacuugcgcuaaguuugccuguucuaaaaagaugaccgguaaauccauucagccugagaaucuggaauaucggaucaugcuuucaguucacggcagccagcauagugggaugauagugaacgacacaggacacgagaccgaugagaaucgcgcaaagguagaaauuacgccaaacucuccccgagcugaggccacuuugggcgguuucgggucccugggacuagacugcgaaccuagaacaggccucgauuuuagcgaccuguacuaccuuaccaugaauaacaaacacuggcuggugcauaaggagugguuccacgacaucccauugcccuggcaugcgggcgccgauacugggacaccucacuggaauaacaaggaagcacucgucgaguuuaaagacgcucacgccaagaggcaaaccgugguugugcugggaucgcaggagggugcuguccauacggccuuagcaggcgcccuggaagcugagauggauggggcgaaaggacggcucucuuccggccaccuuaagugucgucugaaaauggacaaguugcgccuaaaaggugugucauauagucugugcaccgcagccuucacauuuacuaagauuccagcugaaacccuccaugggacaguaacuguugaggugcaguacgccggcaccgauggaccguguaagguccccgcacagauggccguggacaugcaaacacugaccccugucggcagacuuaucacugcuaauccagugaucacggaaagcacagagaacuccaaaaugaugcuggaguuggaucccccuuucggggacucuuauauuguuauaggagugggugaaaagaaaaucacccaccauuggcacaggagcggcucaacuauugggaaggccuuugaggcaaccguacggggagcgaaacgaauggcuguccucggcgauacagccugggacuucgguagugugggaggcgcauuaaauucccugggaaagggcauccaccagauauucggggccgcuuuuaagagccuguucggagguaugucuugguuuucacagauucuaaucggcacccuccugauguggcuuggguugaacacuaaaaacggaaguaucagccugaugugccucgcccugggcgguguucuuauuuuccuguccacagcagugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10794 - RNA, 2017 nt, Artificial Sequence
  ZIKV (isolate Z1106033) ME variant mRNA Design 3 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacgccaaaaacggaaguaucagccugaugugccucgcacugggcggugugcuuaucuuccuguccacugcugucucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10795 - RNA, 2005 nt, Artificial Sequence
  ZIKV (strain MR 766) ME variant mRNA Design 3 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauuaagguggagaacuggauauuucgaaauccuggcuucgcgcugguagcuguggccaucgcauggcuacucgggagcuccaccucucagaaagucauuuaucuggugaugauccuucugauugccccagcuuacucgauccguugcauaggaguuucaaacagagauuuuguggaagguaugagcggcgggacaugggucgacgugguauuggagcauggaggcuguguuaccgugauggcacaggauaagccgacugucgacaucgaacucgugacaaccacggugaguaauauggccgaggucagguccuauugcuacgaggcuucuauuagcgauauggccuccgacucacggugucccacucagggugaagcguaucuggauaaacaaagugacacccaguacguuugcaagcgcacacugguggauagaggguggggaaacggcuguggccucuucgggaaggggagcuuaguaacuugcgcaaaauuuaccuguucuaagaaaaugacagguaaguccauccagccugagaaucuggaauauaggauuaugcuuucagugcacggcagccagcauagugggaugaucggauacgagaccgacgaggaucgggccaaagucgaagugacgccaaacucuccccgcgcugaggccacuuugggcgguuucgggucccugggacuagacugcgaaccucgaacaggccucgauuuuagcgaccuguacuaucuuaccaugaauaacaagcacuggcugguucacaaggagugguuccaugacauaccauugcccuggcacgcaggcgcugauacugggacaccucauuggaauaacaaagaagcccucguggaguuuaaggacgcgcacgccaaaagacaaaccgucgugguacugggaucgcaggagggugcaguucacacggcuuuagccggcgcucuggaagccgagauggauggggcaaagggaaggcuuuucucuggccaucucaaaugucggcugaagauggacaaauugcgucuaaaggguguguccuacucacugugcaccgccgcuuuuacauucacuaaggucccagcggaaacccuccacgggacagugacugucgaggugcaguaugcaggcaccgauggaccguguaaaauucccguucagauggccguggacaugcaaacacugaccccuguaggccgccuuaucacugcuaauccagucauuacggaaaguacagagaacagcaagaugaugcuggaguuggaucccccuuuuggggacuccuacaucgugaucggaguuggugauaaaaagauuacccaucacuggcauagaucuggcagcacuauagggaaagccuucgaagcaaccgugaggggagccaagcggauggcuguccucggcgacacagccugggauuucgguucagugggaggcguauuuaauagucugggaaagggcauccaccagauuuucggggcagcguuuaaauccuuauucggagguaugagcugguuuucucagauccugauaggcacccuacucguguggcuggggcuuaacacuaagaauggaucaauuaguuugacaugccuggcucucggcgguguuaugaucuuccugagcacggccgucuccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10796 - RNA, 2017 nt, Artificial Sequence
  ZIKV (strain NatalRGN) ME variant mRNA Design 3 opt
gggagaaagcuuaccauggacuggaccuggauccuguuccucguggccgcugcaacaagaguccacagcgccguuacucuucccucccauucuacgaggaagcugcagacccggucacaaacaugguuggagagucgcgaauacacuaaacacuuaauucgaguggagaacuggauauuucguaauccuggcuucgcgcuggcugccgcagccaucgcuuggcuacucgggagcuccaccucucagaagguaauuuaucuggugaugauccuucugauugcaccagccuacucgaucagaugcauaggagucucaaacagggauuuuguggaagguaugagcggcgggacauggguugacguggucuuggagcauggaggcugugugaccguaauggcucaggauaaaccgacuguugacaucgaacucgugacaaccacggucaguaauauggccgaggugcgguccuauugcuacgaggcgucuauuagcgauauggcauccgacucacgcugucccacucagggugaagccuaucuggauaagcaaagugacacccaguacgugugcaaaagaacacuggucgauaggggguggggaaacggcuguggccucuucgggaagggaagccugguuacuugcgcuaaguuugccuguucuaaaaagaugaccgguaaauccauccagccugagaaucuggaauaucggauuaugcuuucagugcacggcagccagcauagugggaugaucguaaacgacacaggacacgagaccgaugagaaucgcgcaaagguggaaauaacgccaaacucuccccgagcugaggccacuuugggcgguuucgggucccugggacuagacugcgaaccuagaacaggccucgauuuuagcgaccuguacuaccuuaccaugaauaacaaacacuggcugguccauaaggagugguuccacgacauuccauugcccuggcaugcgggcgccgauacugggacaccucacuggaauaacaaggaagcacucguggaguuuaaagacgcucacgccaagaggcaaaccguugugguccugggaucgcaggagggugcugugcauacggccuuagcaggcgcccuggaagcugagauggauggggcgaaaggacggcucucuuccggccaccuuaagugucgucugaaaauggacaaguugcgccuaaaagguguaucauauagucugugcaccgcagccuucacauuuacuaagaucccagcugaaacccuccaugggacaguuacuguggagguccaguacgccggcaccgauggaccguguaaggugcccgcacagauggccgucgacaugcaaacacugaccccugugggcagacuuauuacugcuaauccaguuaucacggaaagcacagagaacuccaaaaugaugcuggaguuggaucccccuuucggggacucuuauaucgugauuggaguaggugaaaagaaaauaacccaccauuggcacaggagcggcucaacuaucgggaaggccuuugaggcaaccguccggggagcgaaacgaauggcugugcucggcgauacagccugggacuucgguaguguugggggcgcauuaaauuccuuaggaaagggcauucaccagaucuucggggccgcuuuuaagagccuguucggagguaugucuugguuuucacagauacuaauuggcacccuccugauguggcuuggguugaacacuaaaaacggaaguaucagccugaugugccucgcccugggcggugugcuuaucuuccuguccacagcagucucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10797 - RNA, 2035 nt, Artificial Sequence
  ZIKV (strain ZikaSPH2015) ME variant mRNA Design 3 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauauuguguuggagcacgggggaugcgucaccgugauggcacaggacaagccgacaguagauaucgaacucguuaccacuacagugucuaauauggccgagguccggagcuauuguuacgaggcuuccauuucagacauggccagugauagccgcugccccacccagggcgaagcauaucuggacaaacaaucugauacgcaguacguguguaagagaacucugguggacaggggcugggggaacggaugcggucucuuuggcaagggguccuuagucaccugugcuaaauucgccugcucaaagaaaaugacaggaaagagcauccagccugagaaucuggaauaucggauaaugcuuaguguucauggcucucagcacuccgguaugauugugaacgauacugggcaugagaccgacgagaaucgcgcgaaaguagaaaucacaccaaacagcccccgagccgaggcaaccuugggaggcuuuggcucgcuggggcuagauugugaaccuagaacgggacucgacuucucugaucuguacuaccuuacuaugaauaacaagcacuggcuggugcacaaggagugguuucaugacauuccauugcccuggcacgcuggugccgacacaggcaccccucauuggaauaacaaagaagcucucgucgaguucaaggaugcccacgcaaaaaggcaaacugugguugugcuggggucccaggagggagccguccacacagcuuuagcgggcgcacuggaagccgagauggacggugcuaaggggcggcucucaaguggccaucuuaaaugccgucugaagauggauaaauugcgccuaaagggagugagcuauucccuguguaccgccgcauuuacguucaccaagaucccagccgaaacacuccacggcacuguaaccguugaggugcaguacgcugggacagacggaccgugcaaaguccccgcccagauggcaguggauaugcaaacucugaccccugucgguagacuuaucacagcgaauccagugauuaccgaaucuacugagaacagcaagaugaugcuggaguuggaucccccuuuuggcgacucauauauaguuaucggggugggagagaaaaagauuacgcaucacuggcauaggaguggcuccacaaucgguaaggcuuucgaagccaccguacggggcgcaaaacgaauggccguccucggcgacacugcuugggauuuuggaagcgugggcggggccuuaaauucucugggaaaggguauacaccagauuuucggcgcagcuuucaaaucacuguuugggggaaugaguugguucagccagauccuaaucggcacccuccugauguggcuugguuugaacacaaagaacggguccauuucucugaugugccucgcccugggcggaguucuuaucuuucugucgaccgcggugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10798 - RNA, 2035 nt, Artificial Sequence
  ZIKV (isolate Z1106033) ME variant mRNA Design 3 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacgccaagaacggguccaucucucugaugugccucgcgcugggcggagugcuuauuuuucugucgacagccgucagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10799 - RNA, 2023 nt, Artificial Sequence
  ZIKV (strain MR 766) ME variant mRNA Design 3 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauaaaaguggagaacuggaucuuccgaaauccugguuuugcacugguagccguggcuauugcauggcuacucgggucuucgacaucacagaaggucaucuaucuggugaugauucuucugaucgccccagcuuacagcauacguuguaucgggguuaguaacagagacuucguggaaggaauguccggcgguacuugggucgaugugguauuggagcacgggggaugcguuaccgugauggcccaggacaaaccgacagucgauauugaacucgugaccacuacagugucuaauauggcggaggucaggagcuauuguuacgaggcauccaucucagacauggccagugauagccggugccccacccagggcgaggcuuaucuggacaagcaaucugauacgcaguacguuuguaagcgcacucugguggacagaggcugggggaacggaugcggucucuuuggcaaaggguccuuaguaaccugugccaaguucacaugcagcaaaaagaugacuggaaaaucaauucagccugaaaaucuggaauauaggaucaugcuuagugugcauggcucucagcacuccgguaugauaggguacgagaccgaugaggaccgggcaaaggucgaagugacaccaaacagcccccgcgcugaggccaccuugggaggcuuuggcucgcuggggcuagauugugaaccucgaacgggacucgacuucucugaucuguacuaucuuacuaugaauaacaagcauuggcugguucacaaagagugguuucacgacauuccauugcccuggcaugcgggugccgacacaggcaccccucacuggaauaacaaggaagcacucguggaguucaaagaugcucaugccaagagacaaacugucgugguacuggggucccaggagggagcuguucacacagccuuagcaggcgcccuggaagcugagauggacggugcgaaagggaggcucuuuucaggccaccuuaagugccggcugaaaauggauaaguugcgucuaaagggagugaguuacagccuguguaccgcagccuucacguuuaccaaagucccagcugaaacacuccauggcacugugaccgucgaggugcaguaugccgggacagacggaccgugcaagauccccguucagauggcaguggauaugcaaacucugaccccuguaggucgccuuauuacagccaauccagucaucaccgaauccacugagaacucuaaaaugaugcuggaguuggaucccccuuucggcgacagcuacaucgugauugggguuggagacaagaaaauaacgcaccauuggcacagaucaggcaguacaaucgguaaggcuuuugaagccaccgugaggggcgcaaagcggauggcgguccucggcgauacugcuugggacuucggauccgugggcgggguauucaauagccugggaaaagguauucaucagaucuuuggcgccgcauucaagucuuuauuugggggaaugucaugguucagucagauacugauuggcacccuacucguguggcugggucuuaacaccaaaaaugggagcaucuccuugacaugccuggcccucggcggaguuaugaucuuucugucuacugcugucucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10800 - RNA, 2035 nt, Artificial Sequence
  ZIKV (strain NatalRGN) ME variant mRNA Design 3 opt
gggagaaagcuuaccaugggcaagagaagcgccggguccaucauguggcuggcuucucucgcaguggucauugccugcgcgggagcugccguuacccuucccucacacaguacaaggaaacugcagacucggagccaaacgugguuggagucccgcgaauacaccaagcauuuaauacgaguggagaacuggaucuuccguaauccugguuuugcacuggccgcugcagccauugcuuggcuacucgggucuucgacaucacagaaaguaaucuaucuggugaugauucuucugaucgccccagcguacagcauaagauguaucggggucaguaacagggacuucguggaaggaauguccggcgguacuuggguugauguggucuuggagcacgggggaugcgugaccguaauggcacaggacaagccgacaguugauauugaacucgugaccacuacagucucuaauauggccgaggugcggagcuauuguuacgaggcuuccaucucagacauggccagugauagccgcugccccacccagggcgaagcauaucuggacaaacaaucugauacgcaguacguguguaagagaacucuggucgacaggggcugggggaacggaugcggucucuuuggcaagggguccuuaguuaccugugcuaaauucgccugcucaaagaaaaugacaggaaagagcauucagccugagaaucuggaauaucggaucaugcuuagugugcauggcucucagcacuccgguaugauaguaaacgauacugggcaugagaccgacgagaaucgcgcgaaaguggaaauuacaccaaacagcccccgagccgaggcaaccuugggaggcuuuggcucgcuggggcuagauugugaaccuagaacgggacucgacuucucugaucuguacuaccuuacuaugaauaacaagcacuggcugguccacaaggagugguuucaugacaucccauugcccuggcacgcuggugccgacacaggcaccccucauuggaauaacaaagaagcucucguggaguucaaggaugcccacgcaaaaaggcaaacuguugugguccuggggucccaggagggagccgugcacacagcuuuagcgggcgcacuggaagccgagauggacggugcuaaggggcggcucucaaguggccaucuuaaaugccgucugaagauggauaaauugcgccuaaagggaguaagcuauucccuguguaccgccgcauuuacguucaccaagauuccagccgaaacacuccacggcacuguuaccguggagguccaguacgcugggacagacggaccgugcaaagugcccgcccagauggcagucgauaugcaaacucugaccccuguggguagacuuaucacagcgaauccaguuaucaccgaaucuacugagaacagcaagaugaugcuggaguuggaucccccuuuuggcgacucauauauugugauagggguaggagagaaaaagaucacgcaucacuggcauaggaguggcuccacaauugguaaggcuuucgaagccaccguccggggcgcaaaacgaauggccgugcucggcgacacugcuugggauuuuggaagcguuggcggggccuuaaauucucugggaaaggguauccaccagauauucggcgcagcuuucaaaucacuguuugggggaaugaguugguucagccagauucuaaucggcacccuccugauguggcuugguuugaacacaaagaacggguccaucucucugaugugccucgcccugggcggagugcuuauuuuucugucgaccgcggucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10801 - RNA, 2311 nt, Artificial Sequence
  ZIKV (strain ZikaSPH2015) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10802 - RNA, 2311 nt, Artificial Sequence
  ZIKV (isolate Z1106033) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10803 - RNA, 2299 nt, Artificial Sequence
  ZIKV (strain MR 766) prME-short variant mRNA Design 3 opt
gggagaaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10804 - RNA, 2311 nt, Artificial Sequence
  ZIKV (strain NatalRGN) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10805 - RNA, 2290 nt, Artificial Sequence
  ZIKV (strain ZikaSPH2015) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10806 - RNA, 2290 nt, Artificial Sequence
  ZIKV (isolate Z1106033) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10807 - RNA, 2278 nt, Artificial Sequence
  ZIKV (strain MR 766) prME-short variant mRNA Design 3 opt
gggagaaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10808 - RNA, 2290 nt, Artificial Sequence
  ZIKV (strain NatalRGN) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10809 - RNA, 2308 nt, Artificial Sequence
  ZIKV (strain ZikaSPH2015) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10810 - RNA, 2308 nt, Artificial Sequence
  ZIKV (isolate Z1106033) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10811 - RNA, 2296 nt, Artificial Sequence
  ZIKV (strain MR 766) prME-short variant mRNA Design 3 opt
gggagaaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10812 - RNA, 2308 nt, Artificial Sequence
  ZIKV (strain NatalRGN) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10813 - RNA, 2311 nt, Artificial Sequence
  ZIKV (strain ZikaSPH2015) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10814 - RNA, 2311 nt, Artificial Sequence
  ZIKV (isolate Z1106033) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10815 - RNA, 2299 nt, Artificial Sequence
  ZIKV (strain MR 766) prME-short variant mRNA Design 3 opt
gggagaaagcuuaccauggccaucagcggcgugcccgugcugggcuucuucaucaucgccgugcugaugagcgcccaggagagcugggccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10816 - RNA, 2311 nt, Artificial Sequence
  ZIKV (strain NatalRGN) prME-short variant mRNA Design 3 opt
gggagaaagcuuaccauggccaucagcggcgugcccgugcugggcuucuucaucaucgccgugcugaugagcgcccaggagagcugggccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10817 - RNA, 2290 nt, Artificial Sequence
  ZIKV (strain ZikaSPH2015) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10818 - RNA, 2290 nt, Artificial Sequence
  ZIKV (isolate Z1106033) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10819 - RNA, 2278 nt, Artificial Sequence
  ZIKV (strain MR 766) prME-short variant mRNA Design 3 opt
gggagaaagcuuaccauggacuggaccuggauccuguuccugguggccgccgccaccagagugcacagcaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10820 - RNA, 2290 nt, Artificial Sequence
  ZIKV (strain NatalRGN) prME-short variant mRNA Design 3 opt
gggagaaagcuuaccauggacuggaccuggauccuguuccugguggccgccgccaccagagugcacagcgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10821 - RNA, 2308 nt, Artificial Sequence
  ZIKV (strain ZikaSPH2015) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10822 - RNA, 2308 nt, Artificial Sequence
  ZIKV (isolate Z1106033) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaccugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10823 - RNA, 2296 nt, Artificial Sequence
  ZIKV (strain MR 766) prME-short variant mRNA Design 3 opt
gggagaaagcuuaccaugggcaagagaagcgccggcagcaucauguggcuggccagccuggccguggugaucgccugcgccggcgccaucaccagaagaggcagcgccuacuacauguaccuggacagaagcgacgccggcaaggccaucagcuucgccaccacccugggcgugaacaagugccacgugcagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10824 - RNA, 2308 nt, Artificial Sequence
  ZIKV (strain NatalRGN) prME-short variant mRNA Design 3 opt
gggagaaagcuuaccaugggcaagagaagcgccggcagcaucauguggcuggccagccuggccguggugaucgccugcgccggcgccgugaccagaagaggcagcgccuacuacauguaccuggacagaaacgacgccggcgaggccaucagcuuccccaccacccugggcaugaacaagugcuacauccagaucauggaccugggccacaugugcgacgccaccaugagcuacgagugccccaugcuggacgagggcguggagcccgacgacguggacugcuggugcaacaccaccagcaccugggugguguacggcaccugccaccacaagaagggcgaggccagaagaagcagaagagccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcacccugggcaaggccuucagcaccacccugaagggcgcccagagacuggccgcccugggcgacaccgccugggacuucggcagcaucggcggcguguucaacagcaucggcagagccgugcaccagguguucggcggcgccuucagaacccuguucggcggcaugagcuggaucacccagggccugaugggcgcccugcugcuguggaugggcgugaacgccagagacagaagcaucgcccuggccuuccuggccaccggcggcgugcugguguuccuggccaccaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10825 - RNA, 2011 nt, Artificial Sequence
  ZIKV (strain ZikaSPH2015) ME variant mRNA Design 3 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10826 - RNA, 2011 nt, Artificial Sequence
  ZIKV (isolate Z1106033) ME variant mRNA Design 3 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10827 - RNA, 1999 nt, Artificial Sequence
  ZIKV (strain MR 766) ME variant mRNA Design 3 opt
gggagaaagcuuaccaugaccagcaucggcaucaucggccugcugcugaccaccgccauggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10828 - RNA, 2011 nt, Artificial Sequence
  ZIKV (strain NatalRGN) ME variant mRNA Design 3 opt
gggagaaagcuuaccaugaccagcgugggcaucgugggccugcugcugaccaccgccauggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10829 - RNA, 2038 nt, Artificial Sequence
  ZIKV (strain ZikaSPH2015) ME variant mRNA Design 3 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10830 - RNA, 2038 nt, Artificial Sequence
  ZIKV (isolate Z1106033) ME variant mRNA Design 3 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10831 - RNA, 2026 nt, Artificial Sequence
  ZIKV (strain MR 766) ME variant mRNA Design 3 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10832 - RNA, 2038 nt, Artificial Sequence
  ZIKV (strain NatalRGN) ME variant mRNA Design 3 opt
gggagaaagcuuaccauggccaucagcggcgugcccgugcugggcuucuucaucaucgccgugcugaugagcgcccaggagagcugggccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10833 - RNA, 2017 nt, Artificial Sequence
  ZIKV (strain ZikaSPH2015) ME variant mRNA Design 3 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10834 - RNA, 2017 nt, Artificial Sequence
  ZIKV (isolate Z1106033) ME variant mRNA Design 3 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10835 - RNA, 2005 nt, Artificial Sequence
  ZIKV (strain MR 766) ME variant mRNA Design 3 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10836 - RNA, 2017 nt, Artificial Sequence
  ZIKV (strain NatalRGN) ME variant mRNA Design 3 opt
gggagaaagcuuaccauggacuggaccuggauccuguuccugguggccgccgccaccagagugcacagcgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10837 - RNA, 2035 nt, Artificial Sequence
  ZIKV (strain ZikaSPH2015) ME variant mRNA Design 3 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacaucgugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10838 - RNA, 2035 nt, Artificial Sequence
  ZIKV (isolate Z1106033) ME variant mRNA Design 3 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacgccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10839 - RNA, 2023 nt, Artificial Sequence
  ZIKV (strain MR 766) ME variant mRNA Design 3 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucaagguggagaacuggaucuucagaaaccccggcuucgcccugguggccguggccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucaccugcagcaagaagaugaccggcaagagcauccagcccgagaaccuggaguacagaaucaugcugagcgugcacggcagccagcacagcggcaugaucggcuacgagaccgacgaggacagagccaagguggaggugacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacuguucagcggccaccugaagugcagacugaagauggacaagcugagacugaagggcgugagcuacagccugugcaccgccgccuucaccuucaccaaggugcccgccgagacccugcacggcaccgugaccguggaggugcaguacgccggcaccgacggccccugcaagauccccgugcagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgacaagaagaucacccaccacuggcacagaagcggcagcaccaucggcaaggccuucgaggccaccgugagaggcgccaagagaauggccgugcugggcgacaccgccugggacuucggcagcgugggcggcguguucaacagccugggcaagggcauccaccagaucuucggcgccgccuucaagagccuguucggcggcaugagcugguucagccagauccugaucggcacccugcugguguggcugggccugaacaccaagaacggcagcaucagccugaccugccuggcccugggcggcgugaugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10840 - RNA, 2035 nt, Artificial Sequence
  ZIKV (strain NatalRGN) ME variant mRNA Design 3 opt
gggagaaagcuuaccaugggcaagagaagcgccggcagcaucauguggcuggccagccuggccguggugaucgccugcgccggcgccgccgugacccugcccagccacagcaccagaaagcugcagaccagaagccagaccuggcuggagagcagagaguacaccaagcaccugaucagaguggagaacuggaucuucagaaaccccggcuucgcccuggccgccgccgccaucgccuggcugcugggcagcagcaccagccagaaggugaucuaccuggugaugauccugcugaucgcccccgccuacagcaucagaugcaucggcgugagcaacagagacuucguggagggcaugagcggcggcaccuggguggacguggugcuggagcacggcggcugcgugaccgugauggcccaggacaagcccaccguggacaucgagcuggugaccaccaccgugagcaacauggccgaggugagaagcuacugcuacgaggccagcaucagcgacauggccagcgacagcagaugccccacccagggcgaggccuaccuggacaagcagagcgacacccaguacgugugcaagagaacccugguggacagaggcuggggcaacggcugcggccuguucggcaagggcagccuggugaccugcgccaaguucgccugcagcaagaagaugaccggcaagagcauccagcccgagaaccuggaguacagaaucaugcugagcgugcacggcagccagcacagcggcaugaucgugaacgacaccggccacgagaccgacgagaacagagccaagguggagaucacccccaacagccccagagccgaggccacccugggcggcuucggcagccugggccuggacugcgagcccagaaccggccuggacuucagcgaccuguacuaccugaccaugaacaacaagcacuggcuggugcacaaggagugguuccacgacaucccccugcccuggcacgccggcgccgacaccggcaccccccacuggaacaacaaggaggcccugguggaguucaaggacgcccacgccaagagacagaccgugguggugcugggcagccaggagggcgccgugcacaccgcccuggccggcgcccuggaggccgagauggacggcgccaagggcagacugagcagcggccaccugaagugcagacugaagauggacaagcugagacugaagggcgugagcuacagccugugcaccgccgccuucaccuucaccaagauccccgccgagacccugcacggcaccgugaccguggaggugcaguacgccggcaccgacggccccugcaaggugcccgcccagauggccguggacaugcagacccugacccccgugggcagacugaucaccgccaaccccgugaucaccgagagcaccgagaacagcaagaugaugcuggagcuggacccccccuucggcgacagcuacaucgugaucggcgugggcgagaagaagaucacccaccacuggcacagaagcggcagcaccaucggcaaggccuucgaggccaccgugagaggcgccaagagaauggccgugcugggcgacaccgccugggacuucggcagcgugggcggcgcccugaacagccugggcaagggcauccaccagaucuucggcgccgccuucaagagccuguucggcggcaugagcugguucagccagauccugaucggcacccugcugauguggcugggccugaacaccaagaacggcagcaucagccugaugugccuggcccugggcggcgugcugaucuuccugagcaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10841 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcugugggcuguucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgauuggcaaggcguucgaagccacagugcggggcgcuaaaagaauggccguccuuggagauaccgcuugggacuuuggcagcguugggggagcccucaauucccucggcaaggggauccaccaaaucuucggcgccgcuuuuaaaucucuguucggaggcaugagcugguuuucccagauucugaucgggacacuucucauguggcugggacugaacaccaagaauggcagcauuucucucaugugucuggcgcuugggggagugcugaucuuccucuccaccgccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10842 - RNA, 2311 nt, Artificial Sequence
  ZIKV (isolate Z1106033) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcugugggcuguucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacaaucggcaaggcguucgaagccaccguccggggcgcuaaaagaauggccgugcuuggagauacagcuugggacuuuggcagcguugggggagcccucaauucccucggcaaggggauucaccaaaucuucggcgccgcuuuuaaaucucuguucggaggcaugagcugguuuucccagauccugauugggacccuucucauguggcugggacugaacgcgaagaauggcagcaucucucucaugugucuggcccuugggggagugcugauuuuccucuccaccgcugucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10843 - RNA, 2299 nt, Artificial Sequence
  ZIKV (strain MR 766) prME-short variant mRNA Design 3 opt
gggagaaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcugcagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcuguggacucuucgggaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgauuggcaaggccuuugaggcuacaguccgcggggccaaacggauggcggugcuuggagacaccgccugggauuucggcagcguugggggaguguuuaauucccugggcaaggggauccaccaaauuuucggcgcugccuuuaaaucucucuucggaggcaugagcugguuuucccagauccugaucgggacacugcuugucuggcucggacugaacaccaagaacggcagcauuucucugaccugucucgcucuugggggagugaugaucuuccuuuccacagccguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10844 - RNA, 2311 nt, Artificial Sequence
  ZIKV (strain NatalRGN) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcugugggcuguucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgaucggcaaggcguucgaagccacaguccggggcgcuaaaagaauggccgugcuuggagauaccgcuugggacuuuggcagcguugggggagcccucaauucccucggcaaggggauucaccaaaucuucggcgccgcuuuuaaaucucuguucggaggcaugagcugguuuucccagauccugauugggacacuucucauguggcugggacugaacaccaagaauggcagcaucucucucaugugucuggcgcuugggggagugcugauuuuccucuccaccgccgucagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10845 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcaccauuggcaaggccuucgaggcgacagugagaggagccaaacgcauggcugugcuuggcgacaccgccugggauuucggguccgucggaggcgcucucaauucucuggggaagggaauccaucagauuuuuggcgccgccuucaaaagccuguuugggggcauguccugguucucucaaauccugaucggaacccuucucauguggcugggccugaacacaaagaaugggagcauuucccucaugugucuggcucuuggaggcgugcugaucuuucucagcacggcgguuucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10846 - RNA, 2290 nt, Artificial Sequence
  ZIKV (isolate Z1106033) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacaaucggcaaggccuucgaggcgaccgugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacacuucucauguggcugggccugaacgcuaagaaugggagcaucucccucaugugucuggcgcuuggaggcguucugauuuuucucagcacggccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10847 - RNA, 2278 nt, Artificial Sequence
  ZIKV (strain MR 766) prME-short variant mRNA Design 3 opt
gggagaaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcaccauuggcaaggcuuucgaagccacagugcggggagcuaaaagaauggccguccuuggcgauaccgcgugggacuuuggguccgugggaggcguuuucaauucucuggggaagggaauccaucagauuuuuggcgccgcuuucaaaagccucuuugggggcauguccugguucucucaaauccugauuggaacccugcuuguguggcucggccugaacacaaagaacgggagcaucucccugacgugucucgcccugggaggcgucaugaucuuucuuagcaccgcugugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10848 - RNA, 2290 nt, Artificial Sequence
  ZIKV (strain NatalRGN) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcaccaucggcaaggccuucgaggcgacagugagaggagccaaacgcauggcuguccuuggcgacaccgccugggauuucggguccgugggaggcgcucucaauucucuggggaagggcauucaucagaucuuuggagccgccuucaaaagccuguuugggggcauguccugguucucucaaauucugaucggaacccuucucauguggcugggccugaacacaaagaaugggagcaucucccucaugugucuggcucuuggaggcguucugauuuuucucagcacggcggugucugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10849 - RNA, 2308 nt, Artificial Sequence
  ZIKV (strain ZikaSPH2015) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgaucgggaaggcuuuugaggccacagugagaggagcuaagcgcauggccgugcuuggcgauaccgccugggacuucgggagcgucggaggcgcucucaauucccuggggaaaggcauucaccagaucuucggagcggccuuuaagucucuguucggcgggaugagcugguuuucccaaauccugauuggaacacuucucauguggcugggccugaacaccaaaaaugggagcaucucucucaugugccuggcucuuggaggcgugcugauuuuccucuccaccgccguuagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10850 - RNA, 2308 nt, Artificial Sequence
  ZIKV (isolate Z1106033) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacaauugggaaggcuuuugaggccaccgugagaggagcuaagcgcauggccguccuuggcgauacagccugggacuucgggagcgugggaggcgcucucaauucccuggggaaaggcauccaccagauuuucggagcggccuuuaagucucuguucggcgggaugagcugguuuucccaaauccugaucggaacccuucucauguggcugggccugaacgcuaaaaaugggagcauuucucucaugugccuggcccuuggaggcguucugaucuuccucuccaccgccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10851 - RNA, 2296 nt, Artificial Sequence
  ZIKV (strain MR 766) prME-short variant mRNA Design 3 opt
gggagaaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgaucgggaaagccuucgaagcgacagugcggggagccaagagaauggcuguccuuggcgacaccgccugggauuucgggagcgugggaggcguuuuuaauucccuggggaaaggcauucaccagaucuucggagcugccuuuaagucucucuucggcgggaugagcugguuuucccaaauucugaucggaacacugcuuguguggcucggccugaacaccaagaacgggagcaucucucugaccugccucgcccugggaggcgucaugauuuuccuuuccacagcugugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10852 - RNA, 2308 nt, Artificial Sequence
  ZIKV (strain NatalRGN) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgauugggaaggcuuuugaggccacagugagaggagcuaagcgcauggccguccuuggcgauaccgccugggacuucgggagcgugggaggcgcucucaauucccuggggaaaggcauccaccagauuuucggagcggccuuuaagucucuguucggcgggaugagcugguuuucccaaauccugaucggaacacuucucauguggcugggccugaacaccaaaaaugggagcauuucucucaugugccuggcucuuggaggcguucugaucuuccucuccaccgccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10853 - RNA, 2311 nt, Artificial Sequence
  ZIKV (strain ZikaSPH2015) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggauauugugcucgaacauggaggcugugucaccguuauggcccaagacaagcccacgguggauaucgagcuggugacaaccacagucucuaacauggcugaggugcgcuccuacugcuaugaagccagcaucuccgacauggcuucugauagcagauguccuacccagggggaggccuaccuugacaagcaguccgacacccaguauguuugcaaacggacacugguggaucgcggauggggcaauggcuguggccucuucggaaagggcagccuggucacgugcgccaaauuugcuugcucuaagaaaaugaccgggaaguccauucaaccggaaaaccuggaguacagaaucaugcucagcgugcacggaucucagcacagcggcaugauuguuaaugacacagggcaugaaaccgaugagaaccgggcgaagguggagaucacacccaauuccccuagagccgaagcuacccugggaggcuucggcucucuugggcuggacugugagccccgcacgggacucgauuuuagcgaccuguauuaccuuacaaugaacaauaaacacuggcugguccauaaggaaugguuccacgauauuccucuccccuggcacgccggcgccgacaccgggaccccgcauuggaacaauaaagaggcucugguggaauuuaaggaugcccacgcgaaacggcagacagucgugguucugggaucccaggagggcgcugugcauaccgcccucgccggggcucuggaggccgaaauggacggcgcuaagggaagacuuagcucuggccaccugaaaugccgccucaagauggauaagcugcggcuuaaaggggucuccuauagccuguguacagccgcguucacguuuaccaagaucccugccgagacacuccauggaaccgugacaguugaagugcaauacgcuggcaccgacgggcccugcaaagucccugcccagauggcuguggacaugcagacgcugacccccgugggaagacugaucacagccaaccccguuauuaccgagucuacagaaaacuccaagaugaugcucgagcuggauccuccguucggcgacagcuacaucgucauuggggugggcgagaaaaagaucacccaccacuggcaucgcuccggaucuacgcuuggcaaggcguucagcacaacccugaaaggggcccaacggcucgcugcccugggagauacagcuugggacuuuggcuccauugggggaguguucaauucuaucggcagagccguccaccagguguuugggggcgccuuccgcacccuguuuggaggcaugagcuggaucacccaggggcuuaugggagcucuccugcuguggaugggcguuaacgcgcgggauagauccauugcccucgcuuuccuggccacagggggagugcuugucuuucuggccacgaaugugcaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10854 - RNA, 2311 nt, Artificial Sequence
  ZIKV (isolate Z1106033) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaccugugaugcuacaaugucuuacgagugcccgaugcucgacgaaggcguggagcccgaugacgucgauuguuggugcaacaccacaagcaccugggugguuuaugggacaugucaucacaaaaagggagaagccagacggucccgcagagcugugacccugccuucucauagcacgcggaaacuucagacccgcucccagacauggcuggagagcagagaguacaccaagcaccucauccgggucgaaaauuggaucuuucgcaaccccggcuucgcccuggcggccgcugccauugcuuggcugcucgggucuuccacaagccagaaagugaucuaucugguuaugauucuucugaucgccccugcguacucuauuagaugcaucgggguguccaaucgggacuuugucgagggaaugagcggcgggaccuggguggaugugguccucgaacauggaggcuguguuacggugauggcccaagacaagcccacaguggauauugagcuggucaccacaaccgugucuaacauggcugagguucgcuccuacugcuaugaagccagcaucuccgacauggcuucugauagcagauguccuacccagggggaggccuaccuugacaagcaguccgacacacaguaugugugcaaacggacgcuggucgaucgcggauggggcaauggcuguggccucuucggaaagggcagccuggugaccugcgccaaauuugcuugcucuaagaaaaugacagggaaguccauccaaccggaaaaccuggaguacagaauuaugcucagcguucacggaucucagcacagcggcaugaucgugaaugacaccgggcaugaaacagaugagaaccgggcgaaggucgagauuacccccaauuccccuagagccgaagcuacgcugggaggcuucggcucucuugggcuggacugugagccccgcacaggacucgauuuuagcgaccuguauuaccuuaccaugaacaauaaacacuggcuggugcauaaggaaugguuccacgauaucccucuccccuggcacgccggcgccgacaccgggacaccgcauuggaacaauaaagaggcucuggucgaauuuaaggaugcccacgcgaaacggcagaccgugguugugcugggaucccaggagggcgcuguccauacagcccucgccggggcucuggaggccgaaauggacggcgcuaagggaagacuuagcucuggccaccugaaaugccgccucaagauggauaagcugcggcuuaaagggguguccuauagccuguguacggccgcguucaccuuuacaaagauuccugccgagacccuccauggaacaguuaccguggaaguccaauacgcuggcacggacgggcccugcaaagugccugcccagauggcuguggacaugcagacccugacacccguuggaagacugaucaccgccaaccccgucaucacagagucuaccgaaaacuccaagaugaugcucgagcuggauccuccguucggcgacagcuacauugugaucggggugggcgagaaaaagauuacgcaccacuggcaucgcuccggaucuacacuuggcaaggcguucagcaccacacugaaaggggcccaacggcucgcugcccugggagauaccgcuugggacuuuggcuccaucgggggagucuucaauucuauuggcagagccgugcaccagguuuuugggggcgccuuccgcacccuguuuggaggcaugagcuggaucacacaggggcuuaugggagcucuccugcuguggaugggcgugaacgcgcgggauagauccaucgcccucgcuuuccuggccaccgggggaguccuuguguuucuggccacgaauguucaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10855 - RNA, 2299 nt, Artificial Sequence
  ZIKV (strain MR 766) prME-short variant mRNA Design 3 opt
gggagaaagcuuaccauggccaucagcggcgugcccguccugggguucuuuauuaucgcuguucucauguccgcccaggagucuugggcgauuaccagacggggaagcgcuuacuauauguaccuggaccgcuccgaugccggcaaggccaucucuuucgcuacaacgcuuggggugaacaaaugccacgugcaaauuauggaccugggacauaugugugaugccaccaugagcuaugaaugcccuaugcucgacgagggcgucgaaccggaugacguggauuguuggugcaauacaaccuccacauggguuguguacgggaccugucaccauaagaaaggagaggcuagacggucucgcagagccgucacacugcccagccacuccacccggaagcuccagacgcgcagccagaccuggcuggaaucuagagaguauacaaaacaucucaucaagguggagaacuggaucuuucggaauccuggcuucgcgcugguugccguggcuauugccuggcugcucggcuccagcaccucucagaaggucaucuaccuggugaugauucuucugaucgcucccgccuauuccauucgcugcaucggggugagcaacagagacuuugucgaaggaaugucuggcgggacauggguugauguggugcucgagcacggaggcugugucaccgugauggcgcaagacaaaccuacgguugauauugaacuggugacaaccacagucuccaauauggccgaggugcggagcuacugcuacgaggcuuccaucucugacauggccagcgauucccgcugucccacccagggggaggcuuaucuugacaagcagagcgacacccaguacguuugcaaaagaacacugguggaucggggauggggcaacggcugugggcuuuucggaaagggcucucuggucacgugcgccaaauuuaccugcuccaagaagaugacagggaaaagcauccaaccugaaaaucuggaauaucgcauuaugcucucugugcacggaagccagcauuccggcaugaucggguacgagaccgacgaagauagagccaaggucgaggugacaccgaacucuccccgggcugaggcgacccugggaggcuucggcagccuugggcuggacugugaaccuagaacgggacucgauuuuuccgaccuguauuaccuuacaaugaauaacaaacacuggcugguucauaaggagugguuccacgauauuccccucccuuggcacgccggcgcugacaccgggacaccccauuggaauaacaaagaagcccugguggaguuuaaggaugcccacgcuaaacgccagaccgucgugguucugggaagccaggaaggcgccgugcauaccgcgcucgcuggggcccuggaggccgagauggacggcgcuaagggacggcuuuucucuggccaccugaagugcagacucaaaauggauaagcugcgccuuaaaggggucuccuauagccuguguacagccgcuuuuacguucaccaaggugccggccgaaacacuccauggaaccgugacaguugagguccaauacgcgggcaccgacgggccuugcaaaauccccgugcagauggccguggacaugcagacgcugaccccugucggacggcugauuacagcuaaucccgugaucaccgaaucuacagagaacuccaagaugaugcucgaacuggaucccccuuucggcgacagcuacaucguuauuggggugggcgauaagaaaaucacccaccacuggcauagauccggaucuacgcuuggcaaggccuuuagcacaacccugaaaggggcucaacgccucgccgcgcugggagacacagccugggauuucggcuccauugggggagucuuuaauucuaucggccgggcugugcaccagguuuucgggggcgccuuuagaacccuguucggaggcaugagcuggauuacccaggggcuuaugggagcucuccugcuguggaugggcgugaacgcccgcgaccgguccaucgcccucgcuuuucuggcgacagggggaguccuuguguuccuggccacgaacguucaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10856 - RNA, 2311 nt, Artificial Sequence
  ZIKV (strain NatalRGN) prME-short variant mRNA Design 3 opt
gggagaaagcuuaccauggccaucagcggcgugcccguccugggguucuuuauuaucgcuguucucauguccgcccaggagucuugggcggugaccagacggggaagcgcuuacuauauguaccuggaccgcaacgaugccggcgaagccauuuccuucccuacaacgcuugggaugaauaagugcuauauccaaauuauggaccugggacacaugugugaugcuaccaugucuuacgagugcccgaugcucgacgaaggcguggagcccgaugacgucgauuguuggugcaacacaaccagcacaugggugguuuaugggaccugucaucacaaaaagggagaagccagacggucccgcagagcugugacacugccuucucauagcacccggaaacuucagacgcgcucccagaccuggcuggagagcagagaguacacaaagcaccucauccgggucgaaaauuggaucuuucgcaaccccggcuucgcccuggcggccgcugccauugcuuggcugcucgggucuuccaccagccagaaagugaucuaucugguuaugauucuucugaucgccccugcguacucuauuagaugcaucgggguguccaaucgggacuuugucgagggaaugagcggcgggacauggguggaugugguccucgaacauggaggcuguguuaccgugauggcccaagacaagcccacgguggauauugagcuggucacaaccacagugucuaacauggcugagguucgcuccuacugcuaugaagccagcaucuccgacauggcuucugauagcagauguccuacccagggggaggccuaccuugacaagcaguccgacacccaguaugugugcaaacggacacuggucgaucgcggauggggcaauggcuguggccucuucggaaagggcagccuggugacgugcgccaaauuugcuugcucuaagaaaaugaccgggaaguccauccaaccggaaaaccuggaguacagaauuaugcucagcguucacggaucucagcacagcggcaugaucgugaaugacacagggcaugaaaccgaugagaaccgggcgaaggucgagauuacacccaauuccccuagagccgaagcuacccugggaggcuucggcucucuugggcuggacugugagccccgcacgggacucgauuuuagcgaccuguauuaccuuacaaugaacaauaaacacuggcuggugcauaaggaaugguuccacgauaucccucuccccuggcacgccggcgccgacaccgggaccccgcauuggaacaauaaagaggcucuggucgaauuuaaggaugcccacgcgaaacggcagacagugguugugcugggaucccaggagggcgcuguccauaccgcccucgccggggcucuggaggccgaaauggacggcgcuaagggaagacuuagcucuggccaccugaaaugccgccucaagauggauaagcugcggcuuaaagggguguccuauagccuguguacagccgcguucacguuuaccaagauuccugccgagacacuccauggaaccguuacaguggaaguccaauacgcuggcaccgacgggcccugcaaagugccugcccagauggcuguggacaugcagacgcugacccccguuggaagacugaucacagccaaccccgucaucaccgagucuacagaaaacuccaagaugaugcucgagcuggauccuccguucggcgacagcuacauugugaucggggugggcgagaaaaagauuacccaccacuggcaucgcuccggaucuacgcuuggcaaggcguucagcacaacccugaaaggggcccaacggcucgcugcccugggagauacagcuugggacuuuggcuccaucgggggagucuucaauucuauuggcagagccgugcaccagguuuuugggggcgccuuccgcacccuguuuggaggcaugagcuggaucacccaggggcuuaugggagcucuccugcuguggaugggcgugaacgcgcgggauagauccaucgcccucgcuuuccuggccacagggggaguccuuguguuucuggccacgaauguucaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10857 - RNA, 2290 nt, Artificial Sequence
  ZIKV (strain ZikaSPH2015) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacauugugcucgagcacggcgggugugugacagucauggcgcaggauaagccuaccguugacaucgaacuggugacaaccaccguguccaacauggccgaggucagaagcuacugcuaugaggcuucuauuuccgauauggccagcgacucccggugucccacacaaggagaggcuuaccuugacaagcagucugauacgcaguaugugugcaaacgcacccugguugacagaggcugggggaauggauguggccucuuuggcaaggggagccuggugacaugcgccaaauucgccugcuccaagaaaaugaccggaaagagcauccagccugaaaaccuggaauaccggaucaugcucucuguccacggcucccaacauagcgggaugauugugaaugauacaggacacgagaccgacgaaaacagagcuaagguugagaucacgcccaauucuccccgcgcggaggccacacugggcggguuuggaagccuuggccuggauugugaaccucggaccggccucgacuucuccgaucuguauuaccuuaccaugaacaauaaacauuggcuggugcacaaggagugguuucacgacauuccccucccuuggcaugcuggggccgauacaggaaccccgcacuggaacaauaaagaagcccuggucgaguucaaggacgcucaugccaaaagacagacaguggucgugcugggcucucaggaaggggcgguucacacggcucucgccggagcccuggaggcugagauggauggcgccaaggggcgccuuagcuccggccaucugaaaugccggcucaagauggacaagcugagacuuaaaggagugagcuauucucuguguaccgcugccuuuacauucaccaagaucccggcggaaacacuccacggcaccgucacgguggagguucaguacgccgggaccgacggaccuugcaaagugcccgcucaaauggccgucgauaugcagacacugaccccugugggccgccugauuacagcuaaccccgugaucaccgaauccacggagaacagcaagaugaugcucgaacuggaucccccuuuuggggacucuuacaucguuauuggagucggcgagaaaaagaucacacaccauuggcaccgguccgggagcacccuuggcaaggccuucuccacaacccugaaaggagcgcagagacucgccgcucugggcgacaccgccugggauuucgggucuauuggaggcguguuuaauagcaucgggcgcgcugugcaucaagucuucggaggcgccuuucggacacuguucgggggcauguccuggauuacgcagggacuuaugggcgcccuccugcuguggaugggggugaacgcuagagaccgcucuaucgcgcucgccuuucuggcuaccggaggcguucuuguguuccuggccacaaauguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10858 - RNA, 2290 nt, Artificial Sequence
  ZIKV (isolate Z1106033) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaccugugacgccacaaugagcuacgaaugcccuaugcucgaugaggggguggaaccggacgauguggacuguuggugcaacaccacauccaccugggucguguauggaacgugucaccauaaaaagggcgaggcucggcgcucuagacgggccguuacccugcccagccacuccacacgcaaacuucaaaccagaucucagacauggcuggaaagccgggaguacaccaagcaucucauccgcguggagaauuggauuuucagaaacccuggguuugcucuggccgcggccgcuaucgccuggcugcucggauccagcacgucucagaaagucaucuaucuggugaugauucuucugaucgcucccgccuacuccauucggugcaucggcguuagcaaucgcgauuucguggaaggcaugucugggggaacaugggucgacguggugcucgagcacggcgggugugucaccguuauggcgcaggauaagccuacaguggacauugaacuggugaccaccacagucuccaacauggccgaggugagaagcuacugcuaugaggcuucuaucuccgauauggccagcgacucccggugucccacgcaaggagaggcuuaccuugacaagcagucugauacccaguauguuugcaaacgcacacugguggacagaggcugggggaauggauguggccucuuuggcaaggggagccuggugaccugcgccaaauucgccugcuccaagaaaaugacaggaaagagcauucagccugaaaaccuggaauaccggaucaugcucucuguccacggcucccaacauagcgggaugaucguuaaugauaccggacacgagacggacgaaaacagagcuaagguggagauuacacccaauucuccccgcgcggaggccacccugggcggguuuggaagccuuggccuggauugugaaccucggaccggccucgacuucuccgaucuguauuaccuuacaaugaacaauaaacauuggcugguccacaaggagugguuucacgacaucccccucccuuggcaugcuggggccgauaccggaacaccccacuggaacaauaaagaagcccugguggaguucaaggacgcucaugccaaaagacagacggucgugguucugggcucucaggaaggggcggugcacaccgcucucgccggagcccuggaggcugagauggauggcgccaaggggcgccuuagcuccggccaucugaaaugccggcucaagauggacaagcugagacuuaaaggagucagcuauucucuguguacagcugccuuuaccuucacaaagauuccggcggaaacccuccacggcacggugaccguugaggugcaguacgccgggacagacggaccuugcaaaguccccgcucaaauggccguggauaugcagacccugacaccugugggccgccugaucaccgcuaaccccguuauuacggaauccacagagaacagcaagaugaugcucgaacuggacccgccuuuuggggauucuuacaucgucaucggagugggcgagaaaaagauuacccaccauuggcaccgguccgggagcacacuuggcaaggccuucuccaccacccugaaaggagcgcagagacucgccgcucugggcgacacagccugggauuucgggucuaucggaggcguguuuaauagcauugggcgcgcuguccaucaaguguucggaggcgccuuucggacgcuguucgggggcauguccuggaucacccagggacuuaugggcgcccuccugcuguggauggggguuaacgcuagagaccgcucuauugcgcucgccuuucuggcuacaggaggcgugcuugucuuccuggccaccaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10859 - RNA, 2278 nt, Artificial Sequence
  ZIKV (strain MR 766) prME-short variant mRNA Design 3 opt
gggagaaagcuuaccauggacuggaccuggauccuguuccucguggccgcugccacaagaguccacagcauuacgcggcgcggcuccgcguacuauauguaccuggauagaucugacgcugggaaggccaucagcuuugccaccacacuuggaguuaacaaaugccaugugcagauuauggaucugggccacaugugugacgcuaccauguccuaugagugccccaugcucgaugaagggguggagcccgacgaugucgacuguuggugcaauacaaccucuacaugggugguuuacggaaccugucaucacaagaaaggcgaagcccggcgcagcagacgggcugugacgcugccgucccauucuacccgcaaacuucaaacaagaagccagaccuggcuggagucccgggaauauacaaagcaccucaucaaggucgagaacuggauuuuccgcaaucccggguuugcccugguggcgguugccaucgcuuggcugcucggaagcucuaccucccagaaggugaucuaccuggucaugauucuucugaucgccccugcuuauagcauuagaugcaucggcgugucuaaccgggauuucguggagggcauguccgggggaacgugggucgacguugugcucgaacacggcgggugugugacagucauggcccaggauaaacccaccguggacauugagcugguuacaaccaccgugagcaauauggcggaaguccgcucuuacugcuacgaggccuccaucagcgauauggcuuccgacucuagauguccuacacaaggagaggccuaucuugacaagcagagcgauacgcaguacgugugcaaacggacccugguugaccgcggcugggggaacggauguggccucuuuggcaaggggucccuggugacaugcgcuaaauuuaccugcagcaagaagaugacaggaaaaucuauucagcccgaaaaucuggaguauagaaucaugcucuccguccauggcagccaacacucugggaugaucggauacgaaaccgaugaggaccgggccaagguggaagucacgccuaacagcccgagagccgaggcuacacugggcggguuuggaucccuuggccuggauugugagccccgcaccggccucgacuucucugaucuguauuaccuuaccaugaauaacaaacauuggcuggugcacaaggaaugguuucacgacauuccucuccccuggcaugcgggggccgauacaggaaccccucacuggaauaacaaagaggcucugguugaguucaaggacgcccaugccaaacggcagacaguggucgugcugggcagccaggaaggggcuguucacacggcccucgcgggagcucuggaagccgagauggauggcgccaaggggagacuuuucuccggccaucugaagugccgccucaaaauggacaagcugcggcuuaaaggagugagcuauucucuguguaccgcugccuucacauuuaccaagguccccgcugagacacuccacggcaccgugacgguggaaguucaguacgccgggaccgacggaccgugcaaaaucccuguccaaauggcgguggauaugcagacacugacccccgugggcagacugauuacagccaauccugucaucaccgaguccacggaaaacagcaagaugaugcucgagcuggacccucccuucggggauucuuacauugugaucggaguuggcgacaagaaaaucacacaccauuggcaccgcuccgggagcacccuuggcaaggcuuucuccacaacccugaaaggagcccagcggcucgcugcccugggcgauaccgcgugggacuuugggucuauuggaggcguguucaauagcaucgggagagccguccaucaaguguuuggaggcgcuuuccgcacacuguuugggggcauguccuggauuacgcagggacuuaugggcgcccuccugcuguggauggggguuaacgcucgggauagaucuaucgcccucgccuuccuggcuaccggaggcgugcuugucuuucuggcgacaaacgugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10860 - RNA, 2290 nt, Artificial Sequence
  ZIKV (strain NatalRGN) prME-short variant mRNA Design 3 opt
gggagaaagcuuaccauggacuggaccuggauccuguuccucguggccgcugccacaagaguccacagcguuacgcggcgcggcuccgcguacuauauguaccuggauagaaacgacgcuggggaggccauuucuuuucccaccacacuuggaaugaauaagugcuauauccagauuauggaucugggccauaugugugacgccaccaugagcuacgaaugcccuaugcucgaugaggggguggaaccggacgauguggacuguuggugcaacacaaccuccacaugggucguguauggaaccugucaccauaaaaagggcgaggcucggcgcucuagacgggccguuacgcugcccagccacuccacccgcaaacuucaaacaagaucucagaccuggcuggaaagccgggaguacacaaagcaucucauccgcguggagaauuggauuuucagaaacccuggguuugcucuggccgcggccgcuaucgccuggcugcucggauccagcaccucucagaaagucaucuaucuggugaugauucuucugaucgcucccgccuacuccauucggugcaucggcguuagcaaucgcgauuucguggaaggcaugucugggggaacgugggucgacguggugcucgagcacggcgggugugucacaguuauggcgcaggauaagccuaccguggacauugaacuggugacaaccaccgucuccaacauggccgaggugagaagcuacugcuaugaggcuucuaucuccgauauggccagcgacucccggugucccacacaaggagaggcuuaccuugacaagcagucugauacgcaguauguuugcaaacgcacccugguggacagaggcugggggaauggauguggccucuuuggcaaggggagccuggucacaugcgccaaauucgccugcuccaagaaaaugaccggaaagagcauucagccugaaaaccuggaauaccggaucaugcucucugugcacggcucccaacauagcgggaugaucguuaaugauacaggacacgagaccgacgaaaacagagcuaagguggagauuacgcccaauucuccccgcgcggaggccacacugggcggguuuggaagccuuggccuggauugugaaccucggaccggccucgacuucuccgaucuguauuaccuuaccaugaacaauaaacauuggcugguccacaaggagugguuucacgacaucccccucccuuggcaugcuggggccgauacaggaaccccgcacuggaacaauaaagaagcccugguggaguucaaggacgcucaugccaaaagacagacagucgugguucugggcucucaggaaggggcggugcacacggcucucgccggagcccuggaggcugagauggauggcgccaaggggcgccuuagcuccggccaucugaaaugccggcucaagauggacaagcugagacuuaaaggagucagcuauucucuguguaccgcugccuuuacauucaccaagauuccggcggaaacacuccacggcaccgugacgguugaggugcaguacgccgggaccgacggaccuugcaaaguccccgcucaaauggccguggauaugcagacacugaccccugugggccgccugaucacagcuaaccccguuauuaccgaauccacggagaacagcaagaugaugcucgaacuggaucccccuuuuggggacucuuacaucgucaucggagugggcgagaaaaagauuacacaccauuggcaccgguccgggagcacccuuggcaaggccuucuccacaacccugaaaggagcgcagagacucgccgcucugggcgacaccgccugggauuucgggucuaucggaggcguguuuaauagcauugggcgcgcuguccaucaaguguucggaggcgccuuucggacacuguucgggggcauguccuggaucacgcagggacuuaugggcgcccuccugcuguggauggggguuaacgcuagagaccgcucuauugcgcucgccuuucuggcuaccggaggcgugcuugucuuccuggccacaaaugugcacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10861 - RNA, 2308 nt, Artificial Sequence
  ZIKV (strain ZikaSPH2015) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauaucgugcucgagcauggcgggugcgugaccgucauggcccaggacaagccuacgguugauauugaacuggugacaaccacagugucuaacauggcugaggucagauccuacuguuaugaggccagcaucuccgacauggccucugauagccggugccccacccaaggagaggcuuaccuugacaaacaguccgacacccaguauguguguaagcgcacacugguugauagaggcuggggcaaugggugcggacucuucggcaaagggagccuggugacgugcgcgaaguuugccuguucuaaaaagaugaccggaaaguccauccagccugaaaaccuggaauaccggauuaugcucagcguccacggcucucaacacagcgggaugaucgugaaugacacaggacaugagaccgaugaaaacagagcuaaaguugagauuacacccaauuccccgcgcgccgaggccacccugggcggcuucgggucucuuggacuggacugcgaaccucggacgggccucgauuuuagcgaccuguauuaccuuacaaugaacaauaagcacuggcuggugcauaaagagugguuccacgauaucccccucccuuggcacgcuggggccgacaccggaacaccccauuggaacaauaaggaagcgcuggucgaguuuaaagaugcucacgccaagagacagaccguggucgugcugggcucccaggaaggggccguucauaccgcucucgccggcgcucuggaggccgagauggacggagcgaaaggccgccuuagcucugggcaccugaagugucggcucaagauggauaaacugagacuuaagggaguguccuauagccugugcacagccgcuuucacguuuaccaaaauuccggccgaaacacuccauggcaccgucacaguggagguucaguacgcugggaccgacggaccuuguaaggugcccgcccaaauggcggucgacaugcagacgcugaccccugugggccgccugaucacagccaaccccgugaucaccgaaucuacagagaacuccaaaaugaugcucgaacuggaucccccuuucggggacagcuacauuguuaucggcgucggagagaagaagauuacccaccacuggcaucgguccggcucuacgcuugggaaggcuuuuagcacaacccugaagggagcccagagacucgcugcccugggcgauacagccugggacuucggguccaucggaggcguguucaauucuauugggcgcgcugugcaccaagucuuuggcggagcguuccggacccuguuuggcgggaugagcuggaucacccagggacuuaugggcgcccuccugcuguggaugggggugaacgcuagagaucgcuccaucgcccucgccuuccuggcuacaggaggcguucuuguguuucuggccacgaauguccaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10862 - RNA, 2308 nt, Artificial Sequence
  ZIKV (isolate Z1106033) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccauaccugcgaugcuacaaugucuuacgaauguccuaugcucgacgaggggguggaaccggaugacguggauugcugguguaacaccacaagcaccugggucguguauggaacaugccaccacaagaaaggcgaggcccggcgcuccagacgggcgguuacccugcccucucauagcacgcgcaaacuucaaaccagaucccagacauggcuggaaagccgggaguacaccaaacaccucauucgcguggagaauuggaucuuuagaaacccuggcuucgcccuggcugccgcugccaucgcguggcugcucgggucuuccacaagccagaaggucauuuaucuggugaugauccuucugauugcccccgcuuacucuauccgguguauuggaguuuccaaucgcgacuuuguggaaggcaugagcgggggaaccugggucgauguggugcucgagcauggcgggugcgucacgguuauggcccaggacaagccuacaguggauaucgaacuggugaccacaaccgucucuaacauggcugaggugagauccuacuguuaugaggccagcauuuccgacauggccucugauagccggugccccacccaaggagaggcuuaccuugacaaacaguccgacacacaguauguuuguaagcgcacgcugguggauagaggcuggggcaaugggugcggacucuucggcaaagggagccuggugaccugcgcgaaguuugccuguucuaaaaagaugacaggaaaguccauccagccugaaaaccuggaauaccggaucaugcucagcguccacggcucucaacacagcgggaugauuguuaaugacaccggacaugagacagaugaaaacagagcuaaaguggagaucacccccaauuccccgcgcgccgaggccacgcugggcggcuucgggucucuuggacuggacugcgaaccucggacaggccucgauuuuagcgaccuguauuaccuuaccaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauacagcucucgccggcgcucuggaggccgagauggacggagcgaaaggccgccuuagcucugggcaccugaagugucggcucaagauggauaaacugagacuuaagggagucuccuauagccugugcacggccgcuuucaccuuuacaaaaaucccggccgaaacccuccauggcacagugaccguugaggugcaguacgcugggacggacggaccuuguaagguccccgcccaaauggcgguggacaugcagacccugacaccugugggccgccugauuaccgccaaccccguuaucacagaaucuaccgagaacuccaaaaugaugcucgaacuggaucccccuuucggggacagcuacaucgucauuggcgugggagagaagaagaucacgcaccacuggcaucgguccggcucuacacuugggaaggcuuuuagcaccacacugaagggagcccagagacucgcugcccugggcgauaccgccugggacuucggguccauuggaggcguguucaauucuaucgggcgcgcuguccaccaaguguuuggcggagcguuccggacccuguuuggcgggaugagcuggauuacacagggacuuaugggcgcccuccugcuguggauggggguuaacgcuagagaucgcuccaucgcccucgccuuccuggcuacgggaggcgugcuugucuuucuggccaccaaugugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10863 - RNA, 2296 nt, Artificial Sequence
  ZIKV (strain MR 766) prME-short variant mRNA Design 3 opt
gggagaaagcuuaccaugggcaagagaagcgccggguccaucauguggcuggcuucucucgccguggucauugcgugcgcuggagccaucacccggcgcggcagcgccuacuauauguaccuggacagauccgaugcugggaaagccauuucuuucgcuacaacgcuuggaguuaacaagugucacgugcagaucauggaccugggccauaugugcgaugccaccaugagcuaugagugucccaugcucgacgaagggguggagcccgaugacgucgauugcugguguaauacaaccuccacaugggugguuuacggaaccugccaccauaaaaagggcgaagcgcggcgcucuagacgggccgugacacugccgagccacuccacccgcaaacuucaaacgagaagccagaccuggcuggagucucgggaauauacaaagcaucucauuaaggucgagaacuggaucuuucgcaaucccggcuucgcucugguggccguugcuaucgccuggcugcucggguccagcaccucucagaaagugauuuaccuggucaugauccuucugauugcgccugccuauuccaucagauguauuggagugagcaaccgggacuuuguggagggcaugucugggggaacaugggucgauguugugcucgaacacggcgggugcgugaccgucauggcucaggacaagcccacgguggauaucgagcugguuacaaccacaguguccaauauggccgaaguccgcagcuacuguuacgaggcuuccauuucugacauggccagcgauuccagaugcccuacccaaggagaggccuaucuugacaaacagagcgacacccaguacguguguaagcggacacugguugaucgcggcuggggcaacgggugcggacucuucggcaaagggucucuggugacgugcgcuaaguuuaccuguuccaagaaaaugacaggaaagagcauccagcccgaaaaucuggaguauagaaucaugcucucuguccacggcagccaacauuccgggaugauuggauacgaaaccgacgaggaucgggcgaaaguggaagucacaccuaacucuccgagagccgaggcuacccugggcggcuucgggagccuuggacuggacugcgagccccgcacgggccucgauuuuuccgaccuguauuaccuuacaaugaauaacaagcacuggcuggugcauaaagaaugguuccacgauaucccucuccccuggcacgccggggccgacaccggaaccccucauuggaauaacaaggaggcucugguugaauuuaaagaugcccacgcgaagcggcagacaguggucgugcugggcagccaggagggggcuguucauaccgcccucgccggcgcucuggaagccgagauggacggagcuaagggcagacuuuucucugggcaccugaaaugucgccucaagauggauaaacugcggcuuaagggaguguccuauagccugugcacagccgcguuuacguucaccaaaguccccgccgagacacuccauggcaccgugacaguggaaguucaguacgcugggaccgacggaccguguaagauuccuguccaaauggccguggacaugcagacgcugacccccgugggcagacugaucacagcuaauccugucauuaccgagucuacagaaaacuccaagaugaugcucgagcuggauccucccuuuggggacagcuacaucgugaucggcguuggagauaaaaagauuacccaccacuggcaucgcuccggcucuacgcuugggaaagccuucagcacaacccugaagggagcgcagcggcucgccgcucugggcgacacagccugggauuucggguccaucggaggcguguuuaauucuauugggagagcuguccaccaaguguucggcggagccuuucgcacccuguucggcgggaugagcuggaucacccagggacuuaugggcgcccuccugcuguggauggggguuaacgcucgggacagauccauugcgcucgccuuucuggcuacaggaggcgugcuugucuuccuggccacgaacgugcaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10864 - RNA, 2308 nt, Artificial Sequence
  ZIKV (strain NatalRGN) prME-short variant mRNA Design 3 opt
gggagaaagcuuaccaugggcaagagaagcgccggguccaucauguggcuggcuucucucgccguggucauugcgugcgcuggagccguuacccggcgcggcagcgccuacuauauguaccuggacagaaacgaugcuggggaggccaucuccuuccccacaacgcuuggaaugaauaaauguuauauucagaucauggaccugggccacaugugcgaugcuaccaugucuuacgaauguccuaugcucgacgaggggguggaaccggaugacguggauugcugguguaacacaaccagcacaugggucguguauggaaccugccaucacaagaaaggcgaggcccggcgcuccagacgggcgguuacacugcccucucauagcacccgcaaacuucaaacgagaucccagaccuggcuggaaagccgggaguacacaaaacaccucauucgcguggagaauuggaucuuuagaaacccuggcuucgcccuggcugccgcugccaucgcguggcugcucgggucuuccaccagccagaaggucauuuaucuggugaugauccuucugauugcccccgcuuacucuauccgguguauuggaguuuccaaucgcgacuuuguggaaggcaugagcgggggaacaugggucgauguggugcucgagcauggcgggugcgucaccguuauggcccaggacaagccuacgguggauaucgaacuggugacaaccacagucucuaacauggcugaggugagauccuacuguuaugaggccagcauuuccgacauggccucugauagccggugccccacccaaggagaggcuuaccuugacaaacaguccgacacccaguauguuuguaagcgcacacugguggauagaggcuggggcaaugggugcggacucuucggcaaagggagccuggucacgugcgcgaaguuugccuguucuaaaaagaugaccggaaaguccauccagccugaaaaccuggaauaccggaucaugcucagcgugcacggcucucaacacagcgggaugauuguuaaugacacaggacaugagaccgaugaaaacagagcuaaaguggagaucacacccaauuccccgcgcgccgaggccacccugggcggcuucgggucucuuggacuggacugcgaaccucggacgggccucgauuuuagcgaccuguauuaccuuacaaugaacaauaagcacuggcugguccauaaagagugguuccacgauauuccccucccuuggcacgcuggggccgacaccggaacaccccauuggaacaauaaggaagcgcugguggaguuuaaagaugcucacgccaagagacagaccgucgugguucugggcucccaggaaggggccgugcauaccgcucucgccggcgcucuggaggccgagauggacggagcgaaaggccgccuuagcucugggcaccugaagugucggcucaagauggauaaacugagacuuaagggagucuccuauagccugugcacagccgcuuucacguuuaccaaaaucccggccgaaacacuccauggcaccgugacaguugaggugcaguacgcugggaccgacggaccuuguaagguccccgcccaaauggcgguggacaugcagacgcugaccccugugggccgccugauuacagccaaccccguuaucaccgaaucuacagagaacuccaaaaugaugcucgaacuggaucccccuuucggggacagcuacaucgucauuggcgugggagagaagaagaucacccaccacuggcaucgguccggcucuacgcuugggaaggcuuuuagcacaacccugaagggagcccagagacucgcugcccugggcgauacagccugggacuucggguccauuggaggcguguucaauucuaucgggcgcgcuguccaccaaguguuuggcggagcguuccggacccuguuuggcgggaugagcuggauuacccagggacuuaugggcgcccuccugcuguggauggggguuaacgcuagagaucgcuccaucgcccucgccuuccuggcuacaggaggcgugcuugucuuucuggccacgaaugugcaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10865 - RNA, 2011 nt, Artificial Sequence
  ZIKV (strain ZikaSPH2015) ME variant mRNA Design 3 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggauaucguccuggagcacggaggcugugugacgguuauggcgcaggacaaacccaccguggauauugaacuugucacaaccacagugagcaauauggccgaggugcggucuuauugcuacgaggcuuccaucagcgacauggccucugauucccgcuguccuacccagggcgaggcuuaucuggacaagcaaagcgauacgcaguacgucugcaaaagaacacucguugaccggggguggggaaacggcugugggcuguuuggaaagggcucucuugugaccugcgccaaguucgcguguuccaaaaagaugacagggaaaagcauucagcccgaaaaucuggaauaucgcaucaugcucuccgugcauggaucucagcacagcggcaugauugucaacgauaccggccaugagaccgacgagaauagagccaagguggaaaucacaccuaacagcccccgggcugaggccacgcuugggggauuuggcucccuggggcucgauugcgaaccucgcaccggacuggacuucucugaucuuuacuaccugacaaugaauaacaaacacuggcucguucacaaggagugguuucaugacaucccgcugcccuggcacgcuggcgccgacaccgggacaccucauuggaauaacaaggaagcccuuguggaguucaaagaugcucacgcgaagagacaaaccgucgugguucugggaucccaggagggcgccgugcacacggcucucgccggcgcccuggaagcugagauggacggggccaaaggacggcugagcucuggccaucucaagugucgccugaaaauggauaagcugagacugaaaggggucagcuauucccucugcacagcggcuuuuaccuucaccaagauucccgccgaaacacugcacggaaccgugacagucgaggugcaguacgccggcacggacgggccuuguaagguucccgcucagauggccguggauaugcaaacccuuacaccggucggccggcugaucaccgcuaauccugugauuacagaaucuaccgagaacagcaaaaugaugcucgagcuggaucccccuuuuggagacuccuauaucguuauuggcgugggggaaaagaaaaucacgcaucacuggcauagaagcggaucuaccaucggcaaggccuucgaggcgacaguccgcggggccaaacggauggcugugcugggagacaccgccugggauuuuggcuccguugggggcgcucucaauagccugggaaagggcauucaccagaucuucggggccgcguucaagucucuuuuuggaggcauguccugguucagccagauucugaucgggacacuccugauguggcugggacuuaacaccaaaaacggcuccauuucucucaugugccuggcccucgggggcgugcugaucuuucugagcacggcugucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10866 - RNA, 2011 nt, Artificial Sequence
  ZIKV (isolate Z1106033) ME variant mRNA Design 3 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacgccaaaaacggcuccaucucucucaugugccuggcucucgggggcguccugauuuuucugagcaccgccguguccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10867 - RNA, 1999 nt, Artificial Sequence
  ZIKV (strain MR 766) ME variant mRNA Design 3 opt
gggagaaagcuuaccaugaccagcaucggcauuaucgggcugcugcugacaacggccauggcugccgugacccuucccucccacucuacaagaaagcugcagacccggagccaaacauggcucgagucccgcgaauacaccaaacaucugauuaaggucgagaacuggaucuucagaaauccuggauuugcgcuuguugcuguggccauugccuggcugcucggcucuagcacaucccagaaagugaucuaucuggucaugauccugcucauugcuccggccuacucuauccggugcauuggggugagcaaccgcgacuucguugaaggaauguccggcgggaccuggguggaugucgugcuggagcacggaggcuguguuacggugauggcucaggacaagcccaccgucgauaucgaacuugugacaaccacagugagcaauauggccgaggucagaucuuauugcuacgaggcguccauuagcgacauggccucugauucccgguguccuacccagggcgaggcuuaucuggacaaacaaagcgauacgcaguacguuugcaagcgcacacucguggacagaggguggggaaacggcugugggcuguuuggaaagggcucucuugugaccugcgccaaauucacauguuccaagaaaaugaccggaaagagcauccagcccgaaaaucuggaauaucggauuaugcucuccguccaugggucucagcacagcggcaugaucggcuacgagaccgaugaggaccgcgcuaaaguggaaguuacaccuaacucccccagagccgaggcgacgcucgggggauuuggcagccuggggcuggauugcgaaccucggaccggacuggacuucucugaucuuuacuaucugacaaugaauaacaagcauuggcucgugcacaaggagugguuucacgacaucccgcugcccuggcaugccggcgcugacaccgggacaccucacuggaauaacaaagaagcccuugucgaguucaaggaugcucaugccaaacgccaaaccgugguugugcugggaucccaggagggcgccguccacacggcucucgcgggcgcccuggaagcugagauggacggggccaagggaagacuguuuagcggccaccucaaaugucggcugaagauggauaaacuucgccugaagggggugucuuacagccucugcacagccgcuuucaccuuuaccaagguccccgccgaaacacugcauggaaccgugacaguugaggugcaguaugcgggcacggacgggccuuguaaaauucccguccagauggcuguggauaugcaaacccuuacaccgguuggcagacugaucaccgccaauccugugauuacagaauccaccgagaacucuaagaugaugcucgagcuggaucccccuuucggagacagcuacaucgucauuggcgugggggacaaaaagaucacgcaccauuggcaccgguccggaagcaccaucggcaaagccuuugaagcuacagugagaggggccaagcgcauggcuguucugggagauaccgccugggacuucggcucugucgggggcguguucaauucccucggaaagggcauucaucagaucuuuggggcggccuucaaaagccuguuuggaggcaugucuugguucucccagauucuuaucgggacacugcucguguggcugggacugaacaccaagaauggcagcauuucccuuacgugccucgcucucgggggcgucaugaucuuucugucuacagccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10868 - RNA, 2011 nt, Artificial Sequence
  ZIKV (strain NatalRGN) ME variant mRNA Design 3 opt
gggagaaagcuuaccaugaccagcgugggcaucgucgggcugcuccugacaacggccauggcugccguuacccuucccucccacucuacaagaaagcugcagacccggagccaaacauggcucgagucccgcgaauacaccaaacaucugauuagaguggagaacuggaucuuccggaauccuggauuugcgcuugcugccgccgcuauugccuggcugcucggcucuagcacaucccagaaggugaucuaucuggucaugauucugcucaucgcuccggccuacucuauccgcugcauuggggugagcaacagagacuucguugaaggaauguccggcgggaccuggguggaugucgugcuggagcacggaggcuguguuacggugauggcgcaggacaaacccaccgucgauaucgaacuugugacaaccacagugagcaauauggccgagguccggucuuauugcuacgaggcuuccauuagcgacauggccucugauucccgcuguccuacccagggcgaggcuuaucuggacaagcaaagcgauacgcaguacguuugcaaaagaacacucguggaccggggguggggaaacggcugugggcuguuuggaaagggcucucuugugaccugcgccaaguucgcguguuccaaaaagaugacagggaaaagcauccagcccgaaaaucuggaauaucgcauuaugcucuccguccauggaucucagcacagcggcaugaucgugaacgauaccggccaugagaccgacgagaauagagccaagguugaaauuacaccuaacagcccccgggcugaggccacgcuugggggauuuggcucccuggggcucgauugcgaaccucgcaccggacuggacuucucugaucuuuacuaccugacaaugaauaacaaacacuggcucgugcacaaggagugguuucaugacaucccgcugcccuggcacgcuggcgccgacaccgggacaccucauuggaauaacaaggaagcccuugucgaguucaaagaugcucacgcgaagagacaaaccgugguugugcugggaucccaggagggcgccguccacacggcucucgccggcgcccuggaagcugagauggacggggccaaaggacggcugagcucuggccaucucaagugucgccugaaaauggauaagcugagacugaaaggggugagcuauucccucugcacagcggcuuuuaccuucaccaagauccccgccgaaacacugcacggaaccgucacaguggagguucaguacgccggcacggacgggccuuguaaggugcccgcucagauggccgucgauaugcaaacccuuacaccggugggccggcugauuaccgcuaauccuguuaucacagaaucuaccgagaacagcaaaaugaugcucgagcuggaucccccuuuuggagacuccuauauugugaucggcgucggggaaaagaaaauuacgcaucacuggcauagaagcggaucuaccaucggcaaggccuucgaggcgacagugcgcggggccaaacggauggcugugcugggagacaccgccugggauuuuggcuccguugggggcgcucucaauagccugggaaagggcauccaccagauuuucggggccgcguucaagucucuuuuuggaggcauguccugguucagccagauccugauugggacacuccugauguggcugggacuuaacaccaaaaacggcuccaucucucucaugugccuggcccucgggggcguccugauuuuucugagcacggcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10869 - RNA, 2038 nt, Artificial Sequence
  ZIKV (strain ZikaSPH2015) ME variant mRNA Design 3 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgauaucgugcucgaacacggaggcuguguuaccgugauggcucaggacaaaccuacagucgauauugagcuggugaccacgaccguguccaauauggccgagguccggagcuauugcuacgaggcuucuaucuccgacauggccagcgauucucgcugucccacacaaggcgaagcguaucuugacaagcaguccgauacccaguacguuugcaaaagaacacugguggaccggggguggggaaacggcugugggcucuuuggaaagggcagccuggugaccugcgccaaguucgcuuguuccaaaaagaugacggggaaaucuauucagccugaaaaucuugaguaucgcaucaugcugagcguccauggaucccaacacagcggcaugaucgugaacgauacaggccaugagaccgacgaaaauagagccaagguugagauuacacccaacucuccucgggcugaagccacccucgggggauuuggcucccuggggcuggauugcgagccgcgcaccggacucgacuucagcgaucuguacuaccuuacaaugaauaacaaacacuggcuggugcacaaggaaugguuucaugacaucccccucccuuggcacgccggcgcugacacggggacaccccauuggaauaacaaggaggcgcuggucgaguucaaagaugcccacgcuaagagacagacagugguugugcuuggaucucaggaaggcgccguccacaccgcccuggcuggcgcccucgaggcggaaauggacggggcuaaaggacggcugagcuccggccaucugaagugucgccucaaaauggauaagcugagacuuaaaggggugucuuauagccugugcacagccgccuuuaccuucacgaagauuccugcugagacacuccacggaaccgucaccguggaaguucaguacgccggcacagacgggcccuguaaggugccggcucaaauggccgucgauaugcagacccugacaccugugggccggcuuaucacggcgaaucccguuauuaccgaguccacagagaacagcaaaaugaugcuggaacucgacccucccuuuggagauucuuauaucgugaucggcgucggggagaagaaaauuacccaucacuggcauagauccggaagcacaaucggcaaggccuucgaagcuaccgugcgcggggccaaacggauggcugugcugggagacacggccugggauuucggcucuguugggggcgcgcuuaauucccucggaaagggcauucaccagaucuuuggggccgcuuucaagagccuguuuggaggcauguccugguucucucaaauucuuaucgggacccugcucauguggcugggacugaacaccaaaaacggcagcaucucccuuaugugccucgcccucgggggcguccugauuuuucugucuaccgcugugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10870 - RNA, 2038 nt, Artificial Sequence
  ZIKV (isolate Z1106033) ME variant mRNA Design 3 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagaccguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacgccaaaaacggcagcaucucccuuaugugccucgcucucgggggcgugcugaucuuucugucuacagccgugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10871 - RNA, 2026 nt, Artificial Sequence
  ZIKV (strain MR 766) ME variant mRNA Design 3 opt
gggagaaagcuuaccauggccaucagcggcgugcccguccugggguucuuuauuaucgcuguucucauguccgcccaggagucuugggcggcugugacccugccuagccacuccacaagaaaacuucaaacgcggucucagaccuggcuggaaagccgcgaguacacaaagcaucucauuaagguggaaaacuggaucuucagaaauccgggauuugcccuggucgccguggcuauugccuggcuucugggcuccucuaccagccagaaaguuaucuaucucgugaugauccugcugauugcucccgccuacuccauccggugcauuggggucagcaaccgcgacuucguggagggaaugucuggcgggacauggguugaugugguccucgaacacggaggcugugugaccgugauggcgcaggacaagccuacagucgauaucgagcugguuaccacgaccguguccaauauggccgaggugagaagcuauugcuacgaagccucuauuuccgacauggcuagcgauucucggugucccacacaaggcgaggcuuaucuugacaaacaguccgauacccaguacgucugcaagcgcacacugguggacagaggguggggaaacggcugugggcucuuuggaaagggcagccugguuaccugcgccaaauucacguguuccaagaaaaugacagggaagucuauccagccugaaaaucuugaguaucggauuaugcugagcgugcauggaucccaacacagcggcaugaucggcuacgagaccgaugaagaccgcgcgaaagucgaggugacacccaacucuccuagagccgaagcuacccucgggggauuuggcucccuggggcuggauugcgagccgcggaccggacucgacuucagcgaucuguacuaucuuacaaugaauaacaagcauuggcugguucacaaggaaugguuucacgacaucccccucccuuggcaugccggcgcugacacggggacaccccacuggaauaacaaagaggcccugguggaguucaaggaugcccaugcuaaacgccagaccgucgugguccuuggaucucaggaaggcgcggugcacaccgcccuggcuggcgcccucgaggccgaaauggacggggcuaagggaagacuguuuagcggccaccugaaaugucggcucaagauggauaaacugcgccuuaaggggguuuccuacucucugugcacagccgcguucaccuuuacgaaggugccugcugagacacuccauggaaccgucaccguggaaguucaguaugccggcacagacgggcccuguaaaauuccggugcaaauggccgucgauaugcagacccugacaccugugggcagacuuaucacggcuaaucccgugauuaccgagagcacagagaacuccaagaugaugcuggaacucgacccucccuucggagauagcuacaucguuauuggcgucggggacaaaaagaucacccaccauuggcaccggucuggauccacaaucggcaaagccuucgaggcuaccgugagaggggccaagcgcauggcggugcugggagauacggccugggacuuuggcagcgucgggggcguguucaauucucugggaaagggcauucaucagaucuuuggggcugccuucaaaucccucuuuggaggcaugagcugguucucccaaauucugaucgggacccuucugguuuggcucggacugaacacaaagaauggcucuauuagccugaccugccuugcucucgggggcgugaugaucuuucuguccacagccgucucugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10872 - RNA, 2038 nt, Artificial Sequence
  ZIKV (strain NatalRGN) ME variant mRNA Design 3 opt
gggagaaagcuuaccauggccaucagcggcgugcccguccugggguucuuuauuaucgcuguucucauguccgcccaggagucuugggcggcugugacccugccuagccacuccacaagaaagcugcaaacgcggucucagaccuggcuggaaagccgcgaguacacaaaacaucucauuagaguggaaaacuggaucuuccggaauccgggauuugcccuggccgcugccgcuauugccuggcuucugggcuccucuaccagccagaaggucaucuaucucgugaugauccugcugauugcgcccgccuacuccauccgcugcauugggguuagcaacagagacuucguggagggaaugucuggcgggacaugggucgaugugguucucgaacacggaggcugugugaccgucauggcucaggacaaaccuacaguggauaucgagcuggugaccacgaccgucuccaauauggccgagguucggagcuauugcuacgaggcuucuauuuccgacauggccagcgauucucgcugucccacacaaggcgaagcguaucuugacaagcaguccgauacccaguacgugugcaaaagaacacugguggaccggggguggggaaacggcugugggcucuuuggaaagggcagccuggugaccugcgccaaguucgcuuguuccaaaaagaugacggggaaaucuauccagccugaaaaucuugaguaucgcauuaugcugagcguccauggaucccaacacagcggcaugaucguuaacgauacaggccaugagaccgacgaaaauagagccaagguggagaucacacccaacucuccucgggcugaagccacccucgggggauuuggcucccuggggcuggauugcgagccgcgcaccggacucgacuucagcgaucuguacuaccuuacaaugaauaacaaacacuggcugguccacaaggaaugguuucaugacauuccccucccuuggcacgccggcgcugacacggggacaccccauuggaauaacaaggaggcgcugguggaguucaaagaugcccacgcuaagagacagacaguugugguccuuggaucucaggaaggcgccgugcacaccgcccuggcuggcgcccucgaggcggaaauggacggggcuaaaggacggcugagcuccggccaucugaagugucgccucaaaauggauaagcugagacuuaaaggggucucuuauagccugugcacagccgccuuuaccuucacgaagaucccugcugagacacuccacggaaccgugaccguugaagugcaguacgccggcacagacgggcccuguaaggucccggcucaaauggccguggauaugcagacccugacaccuguuggccggcuuauuacggcgaaucccgugaucaccgaguccacagagaacagcaaaaugaugcuggaacucgacccucccuuuggagauucuuauauugucaucggcgugggggagaagaaaaucacccaucacuggcauagauccggaagcacaauuggcaaggccuucgaagcuaccgugcgcggggccaaacggauggcuguucugggagacacggccugggauuucggcucugucgggggcgcgcuuaauucccucggaaagggcauccaccagauuuuuggggccgcuuucaagagccuguuuggaggcauguccugguucucucaaauccuuauugggacccugcucauguggcugggacugaacaccaaaaacggcagcaucucccuuaugugccucgcccucgggggcgugcugaucuuucugucuaccgcugugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10873 - RNA, 2017 nt, Artificial Sequence
  ZIKV (strain ZikaSPH2015) ME variant mRNA Design 3 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacaucguccucgagcauggcgggugugugaccguuauggcccaggauaaacccacgguggacauugaacuggucaccacaaccgugagcaauauggcugaggugcgcucuuauugcuacgaggccuccaucagcgauauggcuucugacuccagauguccuacacagggagaagccuaucuugauaagcaaagcgacacccaguacgucugcaaacggacgcugguugaucgcggcuggggcaacggguguggacucuucggcaaggggucucuggugacaugcgcgaaguuugccuguuccaaaaagaugaccggaaaaagcauucagcccgagaaucuugaauauagaaucaugcuguccgugcacggcucucagcauagcgggaugauugucaacgacacaggacacgagaccgaugagaaucgggcuaagguggaaaucaccccuaacagcccccgcgccgaggcuacacucggcggcuucgggucccugggacuggacugcgaaccuagaacgggccucgauuuuucugaccuguacuaccuuaccaugaauaacaaacacuggcugguucauaaggagugguuccacgacaucccgcuccccuggcaugccggggccgauacaggaaccccucacuggaauaacaaggaagcucugguggaguuuaaagacgcgcacgccaagcggcaaacagucgugguucuuggcucccaggagggggcugugcauaccgcccuggccggagcucucgaagccgagauggauggcgcgaaaggccgccugagcucugggcaccugaaguguagacucaaaauggacaagcugcggcuuaaaggagucagcuauucccugugcacggcugccuucacauuuaccaagauucccgccgaaacccuccauggcacagugaccgucgaggugcaguacgcugggacagauggaccuuguaagguucccgcccagauggcuguggacaugcaaacgcugaccccggucggcagacuuaucacagccaauccugugauuaccgaaucuacagagaacagcaaaaugaugcuggagcucgaucccccuuucggggacuccuauaucguuauuggcgugggagaaaagaaaaucacccaccauuggcaccgcagcggcucuacgaucgggaaggcguuugaggccaccguccggggagcuaaaagaauggccgugcugggcgauacagcuugggacuucggguccgugggaggcgcccugaauagccucgggaagggcauucaccagaucuucggagcggccuuuaagucucuguucggcgggauguccugguuuagccagauucuuaucggaacccugcucauguggcugggccugaacacaaagaacggguccauuucucuuaugugccucgcucugggaggcguucugaucuuccucagcaccgccgucuccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10874 - RNA, 2017 nt, Artificial Sequence
  ZIKV (isolate Z1106033) ME variant mRNA Design 3 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaagcaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacgcuaaaaacggguccaucucucuuaugugccucgcccugggaggcguccugauuuuccucagcacagcuguguccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10875 - RNA, 2005 nt, Artificial Sequence
  ZIKV (strain MR 766) ME variant mRNA Design 3 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauuaagguggagaacuggaucuuucggaauccuggcuucgcucugguggccgucgccauugcuuggcuucuggggucuagcaccucccagaaagugaucuaucucguuaugauucugcugaucgccccggcuuacucuauccgcugcauuggagugagcaacagagauuuugucgaaggcauguccgggggaacauggguggacguugugcucgagcauggcgggugugucaccgugauggcccaggauaagcccacgguggacaucgaacuggucaccacaaccguuagcaauauggcggaggugcggucuuauugcuacgaggccuccauuagcgauauggcuucugacucccgcuguccuacacagggagaagccuaucuugauaaacaaagcgacacccaguacgugugcaagagaacgcuggucgaucggggcuggggcaacggguguggacucuucggcaaggggucucuggugacaugcgcuaaauuuaccuguuccaagaaaaugacaggaaagagcauccagcccgagaaucuugaauaucgcauuaugcuguccguucacggcucucagcauagcgggaugaucggauacgagaccgacgaggauagagccaaaguggaagucaccccuaacagcccccgggcggaggccacacucggcggcuucgggucccugggacuggacugcgaaccucgcacgggccucgauuuuucugaccuguacuaucuuaccaugaauaacaagcacuggcuggugcacaaggagugguuccaugacauuccgcuccccuggcacgcuggggccgauacaggaaccccucauuggaauaacaaagaagcucugguugaguuuaaggacgcccacgccaaaagacaaacaguggucgugcuuggcucccaggagggggcuguccacaccgcgcuggccggagcucucgaagccgagauggauggcgccaagggccggcuguucagcgggcaucugaaaugucgccucaagauggacaaacugagacuuaagggagugucuuacagccugugcacggcugccuuuacauucaccaagguucccgcggaaacccuccacggcacagugaccgucgaggugcaguaugcugggacagauggaccuuguaaaauccccguucagauggccguggacaugcaaacgcugaccccggucggccggcuuaucacagccaauccugugauuaccgaauccacagagaacucuaagaugaugcuggagcucgaucccccuuuuggggacagcuacaucgugauuggcguuggagauaaaaagaucacccaucacuggcauagauccggcagcacgauugggaaggcuuucgaagccaccguccgcggagcuaagcggauggccgugcugggcgacacagcgugggauuucgggucugugggaggcgucuuuaauucccuggggaagggcauccaccagaucuucggagccgcuuuuaaaagccucuucggcgggaugucuugguuuucccagauucugaucggaacccuucugguguggcucggccugaacacaaagaaugggagcauuucccugaccugccuugcccucggaggcguuaugaucuuccugucuacggcugugagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10876 - RNA, 2017 nt, Artificial Sequence
  ZIKV (strain NatalRGN) ME variant mRNA Design 3 opt
gggagaaagcuuaccauggacuggaccuggauccuguuccucguggccgcugccacaagaguccacagcgcgguuacgcugcccucccauucuacccggaaacuucagacacgcagccaaaccuggcuggaguccagagaauacacaaaacaccucauucggguggagaacuggaucuuucgcaauccuggcuucgcucuggccgccgcugccauugcuuggcuucuggggucuagcaccucccagaaggugaucuaucucgucaugauucugcugaucgccccggcguacucuaucagaugcauuggagugagcaaccgggauuuuguugaaggcauguccgggggaacauggguggacgucgugcucgagcauggcggguguguuaccgugauggcccaggauaaacccacggucgacaucgaacuggugaccacaaccgugagcaauauggcugagguccgcucuuauugcuacgaggccuccauuagcgauauggcuucugacuccagauguccuacacagggagaagccuaucuugauaagcaaagcgacacccaguacguuugcaaacggacgcugguggaucgcggcuggggcaacggguguggacucuucggcaaggggucucuggugacaugcgcgaaguuugccuguuccaaaaagaugaccggaaaaagcauccagcccgagaaucuugaauauagaauuaugcuguccguccacggcucucagcauagcgggaugaucgugaacgacacaggacacgagaccgaugagaaucgggcuaagguugaaauuaccccuaacagcccccgcgccgaggcuacacucggcggcuucgggucccugggacuggacugcgaaccuagaacgggccucgauuuuucugaccuguacuaccuuaccaugaauaacaaacacuggcuggugcauaaggagugguuccacgacaucccgcuccccuggcaugccggggccgauacaggaaccccucacuggaauaacaaggaagcucuggucgaguuuaaagacgcgcacgccaagcggcaaacagugguugugcuuggcucccaggagggggcuguccauaccgcccuggccggagcucucgaagccgagauggauggcgcgaaaggccgccugagcucugggcaccugaaguguagacucaaaauggacaagcugcggcuuaaaggagugagcuauucccugugcacggcugccuucacauuuaccaagauccccgccgaaacccuccauggcacagucaccguggagguucaguacgcugggacagauggaccuuguaaggugcccgcccagauggcugucgacaugcaaacgcugaccccggugggcagacuuauuacagccaauccuguuaucaccgaaucuacagagaacagcaaaaugaugcuggagcucgaucccccuuucggggacuccuauauugugaucggcgucggagaaaagaaaauuacccaccauuggcaccgcagcggcucuacgaucgggaaggcguuugaggccaccgugcggggagcuaaaagaauggccgugcugggcgauacagcuugggacuucggguccguuggaggcgcccugaauagccucgggaagggcauccaccagauuuucggagcggccuuuaagucucuguucggcgggauguccugguuuagccagauccuuauuggaacccugcucauguggcugggccugaacacaaagaacggguccaucucucuuaugugccucgcucugggaggcguccugauuuuccucagcaccgccguguccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10877 - RNA, 2035 nt, Artificial Sequence
  ZIKV (strain ZikaSPH2015) ME variant mRNA Design 3 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggauauuguccucgagcacggcggcugcgugaccguuauggcucaggacaagcccacaguggauaucgaacuggucaccacgaccguguccaauauggccgaggugcgcagcuauuguuacgaggcgucuauuuccgacauggccagcgauucuagaugcccuacacagggggaggcuuaucuugacaaacaauccgauacccaguacgucuguaagcggacacugguugaccgcggauggggcaacgggugcggacucuuuggcaaggggagccuggugaccugugccaaauucgcuugcuccaagaaaaugacgggaaagucuauccagcccgaaaaucuugaauauagaauuaugcugagcgugcauggcucccagcacagcggcaugaucgucaacgauacagggcaugagaccgacgagaaucgggccaaaguggaaaucacaccuaacucuccccgcgccgaggcuacccucggaggcuuugggucccugggacuggauugugaaccuagaaccggccucgacuucagcgaucuguacuaccuuacaaugaauaacaagcacuggcugguucacaaggagugguuucaugacauuccgcuccccuggcacgcgggggccgacacgggaaccccucauuggaauaacaaagaagcucugguggaguucaaggaugcccacgccaaacggcaaacagucgugguucuuggcucucaggagggcgcugugcacaccgcccuggcgggggcucucgaagccgagauggacggagccaagggccgccugagcuccgggcaucugaaaugcagacucaagauggauaaacugcggcuuaagggagucucuuauagccuguguacagcugccuuuaccuucacgaagauccccgcugaaacacuccacggcaccgugaccgucgaggugcaguacgccgggacagacggcccuugcaaaguucccgcgcagauggccguggauaugcaaacccugacaccggucggaagacuuauuacggcuaauccugugaucaccgaauccacagagaacagcaagaugaugcuggagcucgaucccccuuuuggcgacucuuauauuguuaucggggugggagagaaaaagaucacccaucacuggcaucgcuccggcagcacaauugggaaagccuucgaagcuaccguccggggagccaagagaauggcggugcugggcgacacggccugggauuuugggucugugggcggagcucucaauucccugggcaaggggauccaccagauuuucggagccgcuuucaaaagccuguuuggcgggauguccugguucucucagauccuuauuggaacccugcucauguggcugggccugaacacaaagaacgggagcaucucccuuaugugccucgcccugggcggaguucugaucuuucucucuaccgccgucagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10878 - RNA, 2035 nt, Artificial Sequence
  ZIKV (isolate Z1106033) ME variant mRNA Design 3 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacgccaagaacgggagcauuucccuuaugugccucgcccugggcggaguccugaucuuucucucuacagcugugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10879 - RNA, 2023 nt, Artificial Sequence
  ZIKV (strain MR 766) ME variant mRNA Design 3 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucaucaaaguggagaacuggauuuuccggaauccuggcuuugcucugguggccgucgcuaucgccuggcuucugggguccucuaccagccagaaggugauuuaucucguuaugauccugcugaucgcgccggccuacuccauucgcuguaucggagugagcaacagagacuucgucgaaggcaugucugggggaacauggguggauguugugcucgagcacggcggcugcgucaccgugauggcucaggacaaacccacaguggauauugaacuggucaccacgaccguuuccaauauggccgaggugcggagcuauuguuacgaggcuucuaucuccgacauggccagcgauucucgcugcccuacacagggggaagcguaucuugacaagcaauccgauacccaguacguguguaagagaacacuggucgaccggggauggggcaacgggugcggacucuuuggcaaagggagccuggugaccugugccaaguucacgugcuccaaaaagaugacaggaaaaucuauucagcccgagaaucuugaauaucgcaucaugcugagcguucauggcucccagcacagcggcaugauuggguacgagaccgaugaggacagagcuaagguggaagucacaccuaacucuccccgggccgaggcuacccucggaggcuuugggucccugggacuggauugugaaccucgcaccggccucgacuucagcgaucuguacuaucuuacaaugaauaacaagcauuggcuggugcacaaagagugguuucacgacaucccgcuccccuggcaugccggggccgacacgggaaccccucacuggaauaacaaggaagcucugguugaguucaaagaugcgcaugccaagagacaaacaguggucgugcuuggcucucaggagggcgcuguccacaccgcccuggccggggcucucgaagccgagauggacggagcgaaaggccggcuguuuagcgggcaccugaagugccgccucaaaauggauaagcugagacuuaagggaguguccuacucucuguguacagcugccuucaccuuuacgaaaguucccgccgaaacacuccauggcaccgugaccgucgaggugcaguaugcugggacagacggcccuugcaagauccccguucagauggccguggauaugcaaacccugacaccggucggacggcuuauuacggcuaauccugugaucaccgaaagcacagagaacuccaaaaugaugcuggagcucgaucccccuuucggcgacagcuacauugugaucgggguuggagacaagaaaauuacccaccauuggcacagaucuggcuccacaaucgggaaggccuuugaagcgaccguccgcggagccaagcggauggcugugcugggcgauacggccugggacuucgggagcgugggcggagucuucaauucucugggcaaagggauccaucagauuuuuggagcugccuucaagucccucuuuggcgggaugagcugguucucccagauccugauuggaacccuucugguguggcucggccugaacaccaaaaaugggucuaucagccugacaugccuugcgcucggcggaguuaugauuuuucuguccacagccgugucugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10880 - RNA, 2035 nt, Artificial Sequence
  ZIKV (strain NatalRGN) ME variant mRNA Design 3 opt
gggagaaagcuuaccaugggcaagagaagcgccggguccaucauguggcuggcuucucucgccguggucauugcgugcgcuggagccgccguuacccugcccagccacuccacacggaaacuucagacgcgcucucaaaccuggcuggagagcagagaauacacaaagcaucucauccggguggagaacuggauuuuccgcaauccuggcuuugcucuggccgcugccgcgaucgccuggcuucugggguccucuaccagccagaaagugauuuaucucgucaugauccugcugaucgcuccggccuacuccauuagauguaucggagugagcaaccgggacuucguugaaggcaugucugggggaacauggguggaugucgugcucgagcacggcggcugcguuaccgugauggcucaggacaagcccacagucgauauugaacuggugaccacgaccguguccaauauggccgagguccgcagcuauuguuacgaggcgucuaucuccgacauggccagcgauucuagaugcccuacacagggggaggcuuaucuugacaaacaauccgauacccaguacguuuguaagcggacacugguggaccgcggauggggcaacgggugcggacucuuuggcaaggggagccuggugaccugugccaaauucgcuugcuccaagaaaaugacgggaaagucuauucagcccgaaaaucuugaauauagaaucaugcugagcguccauggcucccagcacagcggcaugauugugaacgauacagggcaugagaccgacgagaaucgggccaaaguugaaaucacaccuaacucuccccgcgccgaggcuacccucggaggcuuugggucccugggacuggauugugaaccuagaaccggccucgacuucagcgaucuguacuaccuuacaaugaauaacaagcacuggcuggugcacaaggagugguuucaugacaucccgcuccccuggcacgcgggggccgacacgggaaccccucauuggaauaacaaagaagcucuggucgaguucaaggaugcccacgccaaacggcaaacagugguugugcuuggcucucaggagggcgcuguccacaccgcccuggcgggggcucucgaagccgagauggacggagccaagggccgccugagcuccgggcaucugaaaugcagacucaagauggauaaacugcggcuuaagggagugucuuauagccuguguacagcugccuuuaccuucacgaagauucccgcugaaacacuccacggcaccgucaccguggagguucaguacgccgggacagacggcccuugcaaagugcccgcgcagauggccgucgauaugcaaacccugacaccggugggaagacuuaucacggcuaauccuguuauuaccgaauccacagagaacagcaagaugaugcuggagcucgaucccccuuuuggcgacucuuauaucgugauuggggucggagagaaaaagaucacccaucacuggcaucgcuccggcagcacaaucgggaaagccuucgaagcuaccgugcggggagccaagagaauggcggugcugggcgacacggccugggauuuugggucuguuggcggagcucucaauucccugggcaaggggauucaccagaucuucggagccgcuuucaaaagccuguuuggcgggauguccugguucucucagauucuuaucggaacccugcucauguggcugggccugaacacaaagaacgggagcauuucccuuaugugccucgcccugggcggaguccugaucuuucucucuaccgccgugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10881 - RNA, 2311 nt, Artificial Sequence
  ZIKV (strain ZikaSPH2015) prME-short variant mRNA Design 3 opt
gggagaaagcuuaccauggcaauaagcggaguaccaguuuuagguuucuuuauaauagcugucuuaaugucagcacaggaaucaugggcaguaacuagaagagggucagccuauuauauguaccuagauagaaaugacgcuggugaagcgauaaguuuuccaaccacuuuaggcaugaauaaaugcuauauacaaauaauggaccuuggacauaugugcgaugcuacaaugucauacgaaugcccaauguuagaugaagguguagaaccagaugacguagauugcugguguaauacaacgaguacauggguaguauauggaacuugccaucauaagaaaggagaagcaagaagaucaaggagagcaguuacauuaccaucucauucuacuagaaaacuacaaaccagaucucaaacuugguuagaaaguagagaauacacaaaacaucuaauaagaguagaaaauuggaucuuuagaaauccaggauuugcauuagcagcagcagcaauagcauggcuauuaggaagcucaacaagucaaaaaguaauauacuuaguaaugauacuucuaauagcaccagcauauucaauaagauguauagguguaucaaauagagauuuugucgaaggaaugucaggugguacauggguagauauagucuuagaacacggaggaugugucacaguuauggcucaagauaaaccaacaguagauauugagcuaguaacaacgacaguaucaaacauggccgaagucagaucauacuguuaugaagcaucaauaagcgacauggcaagugauaguagauguccgacacaaggagaagcauaucuagacaaacaaucagauacacaguauguaugcaaaagaacauuaguagauagaggcuggggaaacgguugcggauuauuugguaaaggcagccucguaacaugcgcaaaauuugcaugcucgaagaaaaugacagguaaaaguauacaaccagaaaaccuagaauacagaaucauguuaaguguucaugguagucaacauaguggaaugauaguuaacgauacaggacacgaaacugaugaaaauagagcaaaaguagaaauaacaccuaauucuccaagagcagaagcaacacuagggggauuugguucauuaggauuagacugugaaccaagaacagguuuagauuuuucagauuuauauuaccucacaaugaauaacaaacauugguuaguacauaaagaaugguuucaugauauuccauugccuuggcaugccggugcagacacaggcacaccacauuggaauaauaaggaagcacuuguggaauuuaaagaugcacaugcaaaaagacaaacaguuguaguacucgguucacaagaaggagcaguacacaccgcauuagcaggcgcacucgaggcagaaauggauggggcaaaagggagacuaaguaguggacaucugaaaugcagauuaaaaauggacaaacuacgacuaaaaggaguaucauauagucuuugcacagccgcguucacguucacuaaaauaccugcugaaacauuacacggaacgguaacuguagaaguacaauaugcaggaacagauggaccaugcaaaguuccugcgcaaauggcagucgacaugcaaacauuaacaccaguagggagguuaauuacagcuaauccaguuauaacagaaaguacagagaauaguaaaaugaugcuagaauuagauccaccuuuuggggacucuuacauaguaauaggaguaggagaaaagaaaauaacccaucauuggcaucgaaguggaaguacaauaggaaaagcauuugaggcaacaguaagaggagcaaaaagaauggcaguacuuggagauacagccugggacuucggcagugucggaggagcacuaaauaguuuaggaaaagguauacaucaaauuuuuggagccgccuuuaaaucauuauucggagggauguccugguuuagucaaauauuaauuggcacauuauuaauguggcuaggauuaaauaccaaaaauggcucaauaucauuaauguguuuagcguuagguggaguacuaaucuuuuugagcacggcagucagugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10882 - RNA, 2311 nt, Artificial Sequence
  ZIKV (isolate Z1106033) prME-short variant mRNA Design 3 opt
gggagaaagcuuaccauggcuauaagcggaguaccaguccuagguuucuuuauaaucgcugucuuaaugucagcacaagaaucgugggccguaaccagaagaggaagugcauauuauauguauuuagaccgaaaugaugcaggcgaagcgauaucauuuccaacgacauuaggaaugaauaaauguuauauacaaauaauggauuuaggacacacaugcgaugcaaccaugucuuacgaauguccaauguuagacgaaggaguagaaccagaugacguagacuguugguguaauacaaccaguaccuggguaguuuacggaacaugucaucacaagaaaggagaagcaagaagaaguagacgagcaguaaccuugccaucacauucaacaagaaaauuacaaacaagaucacaaacaugguuagaaagucgagaauauacaaaacaucuaauaagaguagaaaacuggauauuuaggaacccuggauuugcacucgcagcagcugcaauugcaugguugcuaggaagcucuacuucccaaaaaguuauuuauuuaguaaugauauuauuaauagcaccagcauauucaauuagauguaucgguguaucuaauagagacuuuguagaaggaaugagcggagguacuuggguagaugucguauuagaacauggaggauguguaacaguaauggcccaagauaaaccaacgguagacauagaauuagucacuacaacuguuucaaauauggcugaaguuagaucauacuguuaugaagcaaguauaucagauauggccagugacuccagauguccaacccaaggagaagcauauuuagacaaacaaagugacacacaauauguaugcaaaagaacucuaguagauagaggcuggggaaauggaugcggauuauuuggaaaggggaguuuaguaacaugcgcaaaauuugcaugcucaaagaaaaugacaggaaaaaguauccaaccagaaaauuuagaauauagaauaauguuaucaguacauggaucgcagcacagcggaaugauuguuaacgacacaggacaugaaacagaugaaaacagagcaaaaguugaaauuacaccaaacucaccaagagcagaagcgacauuaggaggauuuggaucacuagguuuagauugugaacccagaacuggacuugauuucagugacuuauauuaucuuacgaugaauaauaaacacuggcuaguucacaaagaaugguuucaugauauaccacuuccauggcaugcaggagcagauaccggcacaccucacuggaacaauaaagaggcccuaguagaauuuaaagacgcucaugcaaaaagacagacuguugugguauuaggcucacaagaaggagcaguucacacugcgcuagcaggggccuuagaggcagaaauggacggcgcaaaagguagacucucaagcggacauuuaaaaugcagacugaaaauggauaaauuacgacuaaaaggaguuaguuauagccuauguacugccgcauuuacuuucacaaaaauaccagcagaaacacugcauggaacuguaacgguagaaguacaauacgccgguacagacggaccuuguaaaguaccagcacaaauggccguagauaugcaaacacuaacuccuguugguagacuaauaacugcaaauccuguaauaacagaaagcacagaaaauucaaaaaugauguuagaauuagauccaccuuuuggagauucauauauaguaaucgggguuggagaaaagaaaauuacacaccauuggcaucgaucaggaucaacaaucgguaaagccuuugaagcgacaguaagaggugcaaaaagaauggcaguauuaggagauacagcaugggauuuugguucgguaggaggagcauuaaauucacuaggaaaagguauucaccaaauauuuggagcagccuuuaaaaguuuauuuggaggaaugaguugguuuagucaaauuuugauaggaaccuuauuaauguggcuuggacucaacgcaaagaacggaucaauuagcuuaaugugucuagcguuaggaggaguuuugauauuccuaucaacagcaguaagugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10883 - RNA, 2299 nt, Artificial Sequence
  ZIKV (strain MR 766) prME-short variant mRNA Design 3 opt
gggagaaagcuuaccauggccauaucaggaguaccaguauuagguuuuuucauaauagcaguacucaugucagcacaagaaucaugggcgauaacaagaagaggaucagcauauuacauguauuuagauagaucagaugcgggaaaagcaauuuccuuugcaacaacauuaggugugaacaaaugccauguacaaauuauggaucuuggucacaugugcgacgcaacaaugucguacgaaugcccuaugcuugacgaaggaguugaaccagaugacgucgauuguugguguaacacaaccucaacauggguugucuacgguacuugucaucauaaaaaaggggaagcaaggagaucaagaagagcuguaacacuaccaagucauucaacuagaaaauuacaaacaagaagccaaacauggcuagaaucucgagaauauaccaaacacuuaauaaaaguagaaaacuggauauuuaggaauccaggauucgcauuagucgccguagccauugccugguuacugggaucuaguacaagccaaaaagucauuuaccuaguaaugauacuuuuaauagcaccagcauacucaauucgguguauaggugucaguaacagggauuuuguugaagguaugaguggaggaacauggguagauguuguacucgaacacggcggaugugucacaguaauggcacaagauaaaccaacuguagacauagaacuaguaacaacaacuguaucaaacauggcggaaguuagaucauacuguuaugaagcaaguauaucagauauggcaucagauucacgcugcccaacacaaggcgaagcauauuuagauaaacaaagcgauacacaauauguaugcaaacgaacacuaguagacagaggcuggggcaauggaugcggauuauucggcaaaggaagucuuguaaccugugcaaaauuuacaugcucaaaaaaaaugacagguaaaaguauacaaccagaaaaucuagaauaucgaauaauguuaagcguacauggaucacaacauucuggaaugauuggauaugaaacggaugaagauagagcaaaaguagaaguaacaccaaauuccccaagagcagaagccacacuagguggcuuuggaucucuaggcuuagauugugaaccaagaacuggauuagauuuuucagauuuauauuauuugacaaugaauaauaaacauugguugguacauaaagaaugguuucacgauauaccuuuaccauggcaugcuggagcagacacaggaaccccacauuggaacaauaaagaagcauuagucgaguucaaagaugcccaugcaaaaagacaaacgguaguaguucuaggaucccaagaaggagcgguacauacagcacucgcaggagcacuagaagccgaaauggauggugcuaaaggaagauuauuuucaggacaucuuaaauguagauuaaaaauggauaaauuaagacuuaaaggaguaucuuauagucucuguacugcggcuuuuacauuuacaaaaguaccagcagaaacguuacaugguacaguaacaguagaaguacaauacgcaggaacagacgguccauguaaaauuccuguacaaauggcaguagauaugcaaacucugacaccaguagguagauuaauaacagcuaauccuguaauaacagagucaaccgagaacucaaaaaugaugcuagaauuagauccaccuuuuggagauucauauauagucauaggcguaggagacaaaaaaauaacacaucacuggcacagaucaggaaguacuauagggaaggcauuugaagcaacgguaagaggcgcaaaaagaauggcaguauuaggagauaccgcaugggauuuuggaaguguuggugguguguuuaacucuuuagggaaagggauacaucaaauauuuggagcagcauuuaaaagcuuguuuggagguaugucaugguuuucacaaauacuaauaggaacauugcuaguaugguuaggauuaaauacuaaaaauggaagcauaagcuuaacaugcuuagcauuagguggaguaaugauauuuuuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10884 - RNA, 2311 nt, Artificial Sequence
  ZIKV (strain NatalRGN) prME-short variant mRNA Design 3 opt
gggagaaagcuuaccauggcuauuucugggguuccaguauuaggauucuuuauaauagcaguauuaaugucagcacaagaaaguugggcaguaacaagaagaggaagugcauacuauauguauuuggacagaaaugacgcuggagaagccauaaguuuuccaacaacauugggcaugaacaaauguuauauacaaauaauggauuuaggacauaugugugaugcaacaaugucauacgaauguccuaugcuagaugaaggagucgaaccagacgauguagauuguuggugcaauacaacuucaacauggguaguuuauggaaccugucaucauaagaaaggggaagcaagaaggaguagaagggcaguaacuuuacccucucauagcacaagaaaauuacaaacaagaucacaaacuuggcucgaaagcagagaauauacuaaacauuuaauaagaguagaaaauuggauuuucagaaauccaggauuugcucuagcagcagcagcaauagcaugguuacuugguuccaguacaagucaaaaaguaaucuaccuuguaaugauacuucuuauugcuccagcguauucaauaagguguauuggaguaaguaacagagacuucguagaagguaugucuggaggcacguggguagacguaguauuagaacacgguggguguguaacuguaauggcucaagauaaaccaacuguugauaucgaauuagugacaacaacaguuucaaacauggcugaaguacgaagcuacugcuacgaagcaucaauaagugauauggcaagugauagucgaugcccaacacaaggagaagcauaucuagacaaacaaagugauacacaauauguauguaaaagaacacuuguagauagaggauggggaaaugguugugggcuauuuggcaaagggagcuuagucaccugugcaaaauuugcuuguagcaagaaaaugacaggaaaaagcauacaaccagaaaaucuagaauauagaauaauguuaaguguccauggaucacaacauaguggaaugauaguaaaugacaccggacacgaaacugacgaaaaucgagcaaaaguggaaauaacaccaaauagucccagggccgaagcuacauuaggagguuuuggaucacuaggacuggauugugaacccaggacaggguuagauuucagcgauuuauauuauuuaacaaugaacaauaaacauugguugguacauaaagaaugguuucaugauauaccauuacccuggcaugcuggugcugauacaggcacaccucauuggaacaauaaagaagcauuaguagaauuuaaagaugcgcaugcaaaaagacaaacaguugucguuuuaggaagucaagaaggcgcaguacauacugcucuagcaggagcauuagaagcugaaauggauggagcaaaaggcagacugucaaguggacauuuaaaaugucgacuaaaaauggauaaauugcgauuaaaaggaguaucauauuccuuaugcacugcagcuuuuacauuuacaaaaauaccugcagaaacguuacauggaacaguuacaguagaaguucaauacgccggaacagauggaccauguaaaguaccagcacaaauggcaguagacaugcaaacauuaacaccugucggacgacuaaucacagcaaauccaguuauuacagaaucaacagaaaauaguaaaaugaugcuagaauuagauccaccauucggagauucauacauaguaauaggaguuggagaaaagaaaauaacacaccauuggcaucgaagcggaaguacaauaggaaaagcguucgaagcuacaguccguggagcaaaaagaauggcaguauuaggagauaccgcaugggauuuuggaaguguaggcggagcauuaaauaguuuaggaaaagguauacaccaaaucuuuggagcagcauucaaaucacuauuuggaggaaugagcugguuuucgcagauacugauagguacuuuauuaauguggcuaggauuaaauacgaaaaacgguagcauaucauugauguguuuagcacucgguggaguacuaauauuuuuaucuacagcuguauccgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10885 - RNA, 2290 nt, Artificial Sequence
  ZIKV (strain ZikaSPH2015) prME-short variant mRNA Design 3 opt
gggagaaagcuuaccauggauuggacauggauuuuauuucuagucgcagcagcuacaagaguacacuccguaacaagaagaggaucggcauacuauauguauuuagacagaaacgaugcaggggaagcaauaucauuuccaacaacucuugguaugaauaaauguuacauacagauaauggauuuaggacacaugugcgaugccacuaugucguacgagugcccaauguuagacgaagggguggagccggaugauguagauugcugguguaacacuaccucuacauggguagucuauggaacaugucaccacaagaaaggagaagcaagaagaaguagacgagcaguaaccuuaccaagucauucaacaagaaaauuacaaacaagaucacaaacaugguuagaaucaagggaauauacaaaacauuuaauuagaguagaaaacuggauauuuagaaauccugguuuugcuuuggcagcagccgcuaucgcuugguuauuaggaagcagcacaucacaaaaaguaauauauuugguaaugauuuuacucauagcccccgcguauaguauucgauguauagguguaucuaauagagacuucguagaaggaaugucaggaggaacuuggguagacaucguauuagaacacggaggauguguaacaguaauggcucaagacaaaccgacaguagauauagaauugguaacaacaacuguuucuaauauggcagagguacgaucauacuguuaugaagcaagcaucagugauauggcuucagacagccgauguccaacacaaggugaagcauacuuagauaaacaaagcgacacacaauauguaugcaaaagaacguuaguagauagaggcuggggaaaugguugcggguuauucggaaaaggaucauugguaacaugcgcaaaauuugcauguucaaagaaaaugacuggaaaaucuauacaaccugaaaaucuagaauauaggauaauguuaaguguucauggaucucaacacucaggaaugauaguaaaugacacaggacacgaaacggaugaaaauagagccaaaguagaaauaacaccaaauucaccgagagcagaagcgacauugggaggauuugggucacuaggauuagauugugaaccgagaaccggguuagauuuuucugaucucuauuaucuaacaaugaauaauaaacauugguuaguacacaaagaaugguuccaugauauuccauuaccuuggcacgcaggagccgauacagguacuccacacuggaacaauaaagaagcauuaguagaauuuaaagacgcacaugcaaaaagacaaacaguaguaguauuaggaagucaagaaggcgcaguacacaccgcucuagcaggagccuuagaagcagaaauggauggagcaaaggguagauugucuucaggccaucuaaaauguagacuaaaaauggauaaacuaagauuaaaaggaguaagcuacucuuuaugcacagcagcauuuacguuuacaaaaauaccagcagaaaccuuacauggaacuguuacuguagaaguacaauaugcaggaacagauggaccauguaaaguuccagcacaaauggcaguagauaugcaaacauuaacaccaguaggaagauuaauuacagcaaauccaguaauuacagaaucaaccgaaaacucaaaaaugauguuagaauuagacccaccuuucggagacucauauauaguaauaggaguaggagaaaagaaaauuacacaccauuggcaccgauccggaucaacaauaggaaaagcauucgaagcuacaguacgaggcgcaaaaaggauggcagucuuaggagauacagcaugggauuuuggaagcguaggaggagcacuuaacuccuuagguaaaggcauacaucaaauauuuggagcagcguuuaaaucauuauuuggggguaugucuugguuuagccaaauacucauagguaccuuauuaauguggcuaggacuuaauacuaaaaacgguucaauuucauuaauguguuuagccuuaggagguguuuuaauauuucuuaguacagcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10886 - RNA, 2290 nt, Artificial Sequence
  ZIKV (isolate Z1106033) prME-short variant mRNA Design 3 opt
gggagaaagcuuaccauggauuggacauggauauuauuuuuaguggcagcagcaacaagagugcacucagugaccaggagaggaagugcauauuauauguauuuagauagaaaugacgcgggagaagcaauaucauucccaacuacguuaggaaugaauaaauguuauauacaaauaauggauuuaggucauacaugugaugcaacaaugucuuacgaauguccgauguuagacgaaggaguagaaccagaugacguagacugcuggugcaauacaacaaguacuuggguaguauacggaacaugccaucacaaaaaaggagaagcuagaagaucucgaagggcaguaacuuuaccaagucauucuacacgaaaauugcaaaccaggucacaaacaugguuagaaucaagggaauacacaaaacaucugauaagaguagaaaacuggauauuuagaaaucccggguuugcauuagcugcagcagcaauagcauggcuuuuagguucaucaacaucucaaaaaguaauauaucuugugaugauacucuuaauugcaccugcuuacaguauuagguguauaggugucucaaauagagacuuugucgaagggaugaguggugguacauggguugauguugucuuggaacaugguggauguguaacaguaauggcacaagauaaaccaaccguagauauagaauuagucacaacgacaguaucuaacauggcagaaguuagaucuuauugcuaugaagcgucaauaucugauauggccucggacucaagaugcccaacacaaggcgaagcauaucuagauaaacaaucagauacccaguauguauguaaaagaacauuaguugauagagguuggggaaaugguugcggacuauuuggcaaaggaucauuaguaacaugugcaaaauucgcauguagcaaaaaaaugacaggaaaaucaauucaaccagaaaauuuggaguauagaauaaugcuaagugugcacggaagccagcauaguggaaugauuguaaaugauacaggacaugaaacugacgagaauagagcgaaaguagaaaucacaccaaauucaccaagagcugaagcuacacuaggaggauuugguaguuuaggccucgauugugaaccaagaacaggauuagacuucuccgaucuauauuauuuaacaaugaauaauaaacacuggcuaguucauaaagaaugguuucaugauauaccuuuaccuuggcaugcaggagcagauacaggaacuccucauuggaacaauaaagaagcacuaguagaauuuaaagaugcacacgcaaaaagacaaacaguagucguacuaggaagucaagaaggagcaguucauacagcuuuagcaggagcauuagaagcagaaauggauggagcaaaagggagauuaucaucaggacaccuaaaauguagauuaaaaauggauaaauuaagauuaaaaggaguaucauacucauuguguacagcagcauuuacauuuacaaaaauaccagcagaaacauuacauggaacagucacgguugaaguacaauacgccggaaccgacggaccaugcaaaguaccugcacaaauggcaguagauaugcaaacacuaacaccaguaggacgacuaauaaccgcgaauccaguaauaacagaaaguacagaaaauagcaaaaugauguuagaacuagauccuccauuuggagauucauacauaguaauuggagucggggaaaaaaagauuacucaccacuggcaucgaucgggcaguacaauaggaaaagcauuugaagcaacaguacgcggagcaaaaagaauggcaguacuaggagacaccgcaugggauuucgguucaguagguggagcauuaaauucauuagguaaaggaauacaccaaauauucggagccgccuuuaaaaguuuguuuggcggaaugaguugguuuagccaaauauugaucggaaccuuacuaauguggcuggguuuaaaugcaaaaaaugguagcauaagucuaaugugcuuagcacuggguggaguacuaauauuuuuaucaacggcaguaucagcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10887 - RNA, 2278 nt, Artificial Sequence
  ZIKV (strain MR 766) prME-short variant mRNA Design 3 opt
gggagaaagcuuaccauggauuggaccuggauauuauuuuuaguagcagcagcuacuagggugcauucaauaacaagaagaggaucagcuuacuauauguauuuagacagaagcgacgcaggaaaagcaaucagcuuugcuacaacacuagguguaaauaaaugucauguacaaauaauggauuuaggacauaugugugaugcaacaaugaguuacgaauguccuauguuagaugaagguguggaaccugacgauguagauuguuggugcaauacuacuagcacuuggguagucuauggcacaugucaucauaagaaaggcgaagcaaggagaaguagacgugcaguaacauugccaucucacaguacacgaaaauuacaaacuagaucacagacauggcuugaaucaagagaauauacaaaacacuuaauaaaaguagaaaauuggauauucagaaauccuggguucgcacuuguggcugucgcuauagcuugguuacuaggaaguaguacgagucaaaaaguuauauaucuuguuaugauauuacuaauagcaccagcauacaguauaagauguauagggguuucuaacagagacuuuguugaaggaaugucagguggaacauggguagacguaguauuagaacacggaggauguguaacuguaauggcacaagauaaaccaacuguugauaucgaacucguaacaacaacagugagcaauauggcggaagugagaucauacuguuaugaggcaucaaucucagacauggcaucagauucaagauguccaacucaaggugaagcguaucuggacaaacaaucagacacacaauauguauguaaaaggacauuaguugauagaggaugggguaauggaugcggacuauucggaaaagggagcuuaguaaccugugcuaaauuuacauguaguaaaaagaugacaggaaaaucaauacaaccagaaaauuuagaauacagaauaaugcuaucaguccauggcagucaacacagcggaaugauugguuaugaaacggacgaggauagagcuaaaguugaaguaacgccuaauaguccuagagcagaagcuacacuaggaggauuuggaucacuaggauuagacugcgaaccacgaacaggauuagauuuuagugauuuauauuaccuaacgaugaauaacaaacacugguuaguacacaaagaaugguuucacgauauaccauuaccauggcaugcaggcgcugauacaggaacaccacauuggaacaauaaagaggcuuugguagaauuuaaagacgcacaugcuaaaaggcagacaguaguaguauuaggaucacaagaaggagcugugcauacagcacuugcaggagcacuagaagcagaaauggacggggcaaaaggacgauuguucucaggacauuuaaaguguagacuaaaaauggauaaacuaagacuaaaagguguaucauauagccuauguacugccgcauuuacguuuacuaaagucccagcagaaacucuacauggaaccguaacugucgaagugcaauaugcagguacagauggcccuuguaaaauaccaguucaaauggcaguggacaugcaaacauuaacaccgguaggaagauuaauaacagcaaauccgguuauaacggaaucaacagaaaauaguaaaaugaugcuagaauuggauccaccauuuggugauucauauauaguaauaggcguaggagacaagaaaauaacacaucacuggcauagaagcggaucaacaauagguaaagcauuugaagcuacuguaagaggagcaaaaagaauggcaguccuaggugauacagcuugggacuuugguagcguaggaggaguguuuaauucacucggaaaagguauucaccaaaucuuuggagccgcuuuuaaaucauuauucggagguaugagcugguucucacaaauccuaauaggaacacuauuagugugguugggacuaaauacuaaaaaugguagcauaucacuaacauguuuagcauuaggagggguuaugauauuucuaaguacagcuguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10888 - RNA, 2290 nt, Artificial Sequence
  ZIKV (strain NatalRGN) prME-short variant mRNA Design 3 opt
gggagaaagcuuaccauggauuggacauggauauuauuuuuaguagcagcagcaacgagaguacauaguguaacaagacgagguuccgcauacuacauguauuuagauagaaaugaugcgggagaagccauaucauucccgacgacauuaggaaugaauaaauguuauauccaaauaauggauuuaggacacaugugugaugcaacaaugucauaugaauguccaauguuagacgaaggaguugaaccugaugauguagauuguugguguaacacaacuagcacguggguugucuauggaacaugucaucauaagaaaggagaagcaagacggaguaggagagcaguaacauugccaucacacaguacaagaaaacuacaaacacgaagucaaacaugguuagagagccgagaauauacaaaacaucuaauaagaguagaaaauuggauuuucagaaauccagguuuugcauuagcagcagcagcaauagccugguuauuaggaucaucaacaagucaaaaaguaauauauuuagucaugaucuuauuaauagcaccagcguauucaauacgauguauuggaguaucuaacagggauuucguagaagguaugucaggaggaacauggguagauguaguacuugagcauggaggaugugugacaguaauggcacaagauaaaccaacgguugauauagaauuaguaacaacaacaguaucaaacauggcagaaguaagaaguuauugcuaugaagcaagcauaucagauauggcuucugacagucgauguccaacacaaggagaagcauauuuagacaaacaaucugauacucaauaugucugcaaaagaacauugguagauaggggguggggaaauggauguggauuguuuggaaaaggaagucuaguaacgugugcaaaauuugcuugcucgaaaaaaaugacuggaaaaaguauacaaccagaaaaucuugaauauagaauaauguuaaguguucauggaagucaacauucaggaaugauuguaaaugauacuggacaugaaacggacgaaaauagggccaaaguagaaauaacaccuaauaguccuagagcugaagccacauuaggaggauucggaucauuaggacucgacugugaaccaaggacaggacuagauuucucugacuuguauuacuuaacaaugaauaauaaacauugguuaguacacaaagaaugguuucacgauauaccacuaccauggcaugcgggagcugauacagguacuccacacuggaauaauaaagaagcacucguagaauuuaaagacgcacacgcaaaaagacaaacaguuguaguauuagguucacaagagggcgcaguacauacagcauuagcaggugcuuuagaagcugaaauggacggagcaaaaggaagauuaucaaguggacaccuaaaaugcagauugaaaauggauaaauuacgauuaaaaggaguaucuuauagccuuuguacugccgcauuuaccuuuacaaaaauaccagcagaaacauuacauggaacuguaacaguagaaguacaauacgcuggcacugacggaccauguaaaguaccggcucaaauggcgguagauaugcaaacauuaacaccaguaggucgccuaauaacagcaaauccaguaauaacugaaagcacugagaauuccaaaaugauguuagaauuggauccaccuuuuggagauucauacauaguaauuggaguaggugaaaaaaaaauaacacaucacuggcauagauccggaucaacaauaggaaaagcauuugaagcaacaguucguggggcuaaaagaauggcaguacuaggagauacagccugggauuucggaucgguaggaggugcauuaaacucauuaggaaaagguauacaucaaauauuuggagcagccuucaaaagucucuuuggaggcaugaguugguucagucaaauauugauaggaacucuauuaauguggcucggcuuaaauacaaaaaaugguucaauuucauuaauguguuuagcauuaggaggaguauuaauuuucuuaucaaccgcaguauccgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10889 - RNA, 2308 nt, Artificial Sequence
  ZIKV (strain ZikaSPH2015) prME-short variant mRNA Design 3 opt
gggagaaagcuuaccaugggaaaaagaucagcuggaaguauaaugugguuagcaucauuagcuguaguaauagcaugcgcaggagcuguaacaagaagaggaagcgcauauuauauguaccuagauagaaacgacgcaggagaagcuaucucuuuuccaacaacauuaggaaugaauaaauguuauauacaaauuauggauuuaggacauaugugcgacgcaacaaugucauaugaauguccuauguuagacgaaggaguagaaccagacgauguagauuguugguguaauacaacaaguacuuggguaguuuauggcacaugccaucauaagaaaggggaagcucgaagaagcagacgagcaguaacauuaccaagucauagcacaagaaaacuacaaacaagaagccaaacaugguuagaaucuagagaauauacuaaacauuuaauacgcguagaaaacuggauauucagaaauccaggauuugcacuagcagcagcagcaauagcaugguuauuaggaucaaguacaucacaaaaaguaauauacuuaguaaugauacuauuaauagcaccagcuuacucaauaagaugcauaggaguaucaaaucgugacuuuguagaaggcaugagcgggggcacauggguagauauuguacuagaacauggugguuguguuacaguuauggcucaagauaaaccuaccguugauauagaguuaguaacaacaacaguaagcaauauggcagaaguaagaucauacuguuacgaagcaucaauaagcgauauggcaucagauaguagaugcccaacucaaggagaagcauacuuagauaaacaaucagauacacaauauguaugcaagcgaacccuaguggaccgaggauggggaaauggauguggacuauuuggaaaaggcucucuuguuacaugugcaaaauuugcauguucuaagaaaaugacaggaaaaucaauacaaccugaaaacuuagaauacagaauaauguuaagcguucauggaagucaacacucagguaugauaguaaaugauacaggacacgagaccgaugaaaacagagcaaaaguagaaauaacacccaacucaccaagagcagaagcaacccuuggcgguuuuggaaguuuaggauuagauugugagccuagaacugguuuagauuucucagauuuauauuauuuaacuaugaauaauaaacauuggcuaguccauaaagaaugguuucaugauauaccuuugccauggcaugcgggugcagauaccggaacaccacacuggaacaacaaagaagcacuuguagaauuuaaagaugcccacgcaaaaagacaaacuguaguaguacuuggaagucaagaaggagcaguucauacugcauuagcaggagcauuagaagcagaaauggauggagccaaaggaagauuaaguucuggacaucuuaaauguagguuaaaaauggauaaauuaagacuaaaaggcguuucauacucauuauguacagcagcauucaccuucacaaaaauaccagcugaaacauuacacggaacaguaacaguugaaguucaauaugcaggaacugaugggccauguaaaguaccugcacaaauggcaguagauaugcaaacacuaacaccaguaggaagacuaauaacagcaaacccuguaauuacggaaucuacagaaaacagcaaaaugauguuagaguuggauccacccuuuggagauagcuauauaguuauaggagugggugaaaagaaaauaacgcaucauuggcacagaagugguaguacaauaggaaaagcauuugaggcaaccguaagaggggcaaaaaggauggcaguccuaggagacacagcuugggacuuuggaagcguaggcggggcccuuaauuccuuaggaaagggaauacaccaaauauuuggagcagcauuuaaaucauuauucgguggcaugucuugguuuucucaaauacuaauaggaacauuauuaauguggcuuggacuaaauaccaaaaauggcucaaucucauuaaugugucuugcuuuaggagguguacuaauauuuuuaaguacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10890 - RNA, 2308 nt, Artificial Sequence
  ZIKV (isolate Z1106033) prME-short variant mRNA Design 3 opt
gggagaaagcuuaccauggguaaaagaucagcuggaucaauaaugugguuagccucacuagcaguuguuauagcaugugcuggagcgguaacuagaagagguagugccuauuacauguaccuagauagaaacgaugcaggagaagccauaucauuuccaacaacauuagguaugaauaaaugcuauauucaaauaauggauuuaggacacacaugugaugcaacaaugucuuaugaauguccaauguuagaugaaggaguugaaccagaugauguagauuguugguguaauacaacaaguacauggguuguauacggaacgugucaucauaaaaaaggagaagcacgaagaaguagacgagcugucacauuaccaagucauagcacucguaaauuacaaacaagaagucaaacuuggcuagaaagcagagaauauacgaagcaucuaauaaggguugaaaacuggauauucagaaacccaggauuugcuuuagcagcugcugcaauagcauggcuauuaggaagcucaacaagucaaaaagucauauauuuaguaaugauacuucuaauagcaccagcauacaguauuagaugcauaggaguaaguaauagggauuuuguagaaggaaugaguggagguacauggguugacguaguauuagaacauggaggauguguaacaguaauggcacaagacaaaccuacaguagacauagaauuaguaacaacuacaguuucuaauauggccgaaguacgaagcuauuguuaugaggcaucaauaucagauauggcaucagacucaagauguccaacucaaggggaagcguaucuagauaaacaauccgacacccaauacguauguaaacgaacacuuguagauagaggauggggaaacgguuguggauuauuugguaaagguaguuuaguaacuugcgcaaaauuugcauguucaaaaaagaugacaggcaaaucaauacaaccagaaaaccuggaauauagaauaauguuaucaguacauggcucacaacauagugguaugaucguuaacgauacuggacaugaaacagaugaaaaucgagcgaaaguagaaauaacgccaaauucaccuagagcugaagcaacauuaggaggauuugggagcuuaggacuugacugugaaccuagaacaggauuagauuucagcgaucuauacuaucuuacgaugaauaauaaacauuggcucguacacaaagagugguuucaugauauuccucuuccauggcacgcaggagcugauacugggacaccacauuggaauaauaaagaagcuuuaguagaauucaaagaugcacacgcaaaaagacaaacaguaguuguguuaggaucucaagaaggagcgguacauacagcauuagcaggagcccuagaagcagagauggauggagcaaaaggacgguuaucaucaggacaucuaaaauguagacuuaaaauggacaaauuaagacuaaaaggaguaucuuauucauuaugcacagcagcauuuaccuuuacaaaaauaccggcagaaacacuucauggaacaguuacaguagaaguacaauacgcaggaacagauggcccaugcaaagucccagcacaaauggcuguagauaugcaaacauuaacuccaguagguagacuuauaacagcaaauccgguaauaacagagucaacggaaaauucaaaaaugauguuagaacuagauccaccauuuggagacaguuacauaguuauuggcgucggagaaaaaaaaauaacacaucacuggcauaggagcggaaguacaauuggaaaagcauucgaagcuacaguuagaggagccaaaagaauggcuguauuaggagacacugcgugggacuuuggaaguguaggaggcgcauuaaauagcuuagguaaaggaauacaucaaauauuuggugcggcauucaaaucacuguucggaggaaugaguugguuuucacaaauacuaaucggaacuuuacuaaugugguuagguuuaaaugcaaaaaauggaucaauaaguuuaaugugccuggcauuaggaggaguauugauauuuuuaagcacagcagugucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10891 - RNA, 2296 nt, Artificial Sequence
  ZIKV (strain MR 766) prME-short variant mRNA Design 3 opt
gggagaaagcuuaccaugggaaaaagaucagcagggaguauaaugugguuagcaagucuagcaguugucauagcgugcgcaggugcaaucacuagaagaggaagcgcauauuacauguauuuagauagaagugaugcaggaaaagcaauuucauuugcuacaacauuaggcgucaauaaaugucauguacaaaucauggauuuaggucauaugugugaugcaaccaugagcuacgaauguccaauguuagaugaaggaguagaaccugaugacguagacugcugguguaauacaacaaguacauggguaguauauggaacgugccaucacaaaaaaggagaagcaagaagaagccgaagagcggucacccuaccaagucauagcacuagaaaauuacaaacaaggagucaaacauggcuagaaagcagagaauauacaaaacacuuaauaaaaguagaaaauuggauauuucguaauccaggcuucgcacuaguagcaguagccauagcaugguugcuuggaucaucgacaagucaaaaaguuaucuauuuaguaaugauauuauuaauagcgccugcauacucaauacgauguauaggaguaucuaacagagauuucguagaaggaaugucuggagguacuuggguagauguaguucuggaacaugguggauguguuacuguaauggcccaagacaaaccaaccguagauauugaacuaguaacuacuacuguaagcaacauggcggaaguacgaucauauuguuacgaagcaaguauaagugauauggcaucagauucuagaugcccgacccagggagaagcauauuuagauaagcaaagugacacccaauacguauguaaaagaacauugguagauagaggauggggaaacggauguggauuauucggcaaaggaaguuuaguaacaugugcuaaauuuaccugcaguaaaaaaaugacaggcaaaaguauacaaccagaaaauuuagaauacagaauaaugcuaagcguacauggaucucaacauucaggaaugauaggauaugaaacagaugaagauagggcuaaaguagaagucacaccuaauagcccaagagcggaagcgacccuggguggguuuggaucauuaggauuagauugcgaaccgagaaccggauuagauuuuagugauuuauauuauuuaacaaugaacaauaaacauugguuagugcauaaagagugguuccaugacauaccacuaccauggcaugcaggugcagacacuggaacaccacauuggaauaauaaagaagcauuagucgaauucaaagaugcucaugcgaaaagacaaacaguagugguucuaggaucucaagaaggagcaguacacacagcauuagcaggagcgcuagaagcagaaauggauggcgcaaaaggaagauuauucagcggucauuuaaaauguagauuaaaaauggauaaauuaagacuuaaaggaguaucauauucucuaugcacagcagcauuuacuuuuacuaaaguaccagccgaaacauuacauggcacgguaacugucgagguacaauaugcagguacagacggaccuuguaaaauaccaguacaaauggcaguggauaugcaaacauuaacuccaguaggcaggcuaauaacagcuaauccaguaauaacagaaucaacugaaaacagcaaaaugauguuggaauuagauccaccauuuggcgauuccuauauaguaauagggguaggagauaaaaaaauaacacaccauuggcacaggaguggaaguacaauagggaaagcauuugaagcgacaguaagaggagcaaaaaggauggcaguacuaggagauacagcaugggauuuugguagcgugggagguguauuuaacucacuaggcaaggggauacaucaaauauuuggcgcagcauuuaaaagcuuauuuggaggaaugaguugguuuucacaaauucugauaggaacucuuuugguaugguuaggauuaaauacaaaaaacgguucuauaaguuuaacaugucuagcauuaggggguguaaugauauuucuaaguacugcaguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10892 - RNA, 2308 nt, Artificial Sequence
  ZIKV (strain NatalRGN) prME-short variant mRNA Design 3 opt
gggagaaagcuuaccaugggaaaaagaucagcagguucaauaaugugguuagcaucauuagcgguaguaauagcaugugcaggagccguaacgcguagagguucagcuuauuauauguaucuugauagaaacgaugcuggugaagcaauaucauuuccaaccaccuuaggaaugaauaaauguuauauacaaauaauggaccuaggacauaugugugacgcgacaaugucauacgagugcccuauguuagacgaaggaguagaaccagaugacguagauuguugguguaauacaacgucaacguggguaguauauggcacaugccaccauaagaaaggugaagcucgcagaagcaggagagcaguuacauugccaagccauucgacuagaaaauugcaaaccagaagucaaacaugguuagaaaguagagaauauacuaaacaucugauacgaguagagaacuggauauuuagaaauccaggauucgcguuagcagcggcagcaauagccugguuauuaggaaguucaacaagucagaaaguaauauaucuaguaaugauacuauuaauugcuccugcauauucaauaagauguauaggaguaucaaauagagauuuuguagaaggaaugucuggcggaacuuggguagauguaguacuagaacacggggguugugucacuguaauggcacaagauaaaccaacaguggauauagaauuaguaaccacaacaguaaguaauauggcagaaguaagaucauauuguuaugaagcaaguauaagugacauggcaucagauagcagauguccaacacaaggcgaagcauacuuagauaaacaauccgacacacaauacguauguaaaagaacauuagucgauagaggauggggaaauggauguggauuauuuggaaaagggucauugguaacaugugcaaaauucgcauguagcaagaaaaugacuggaaaaucaauacaaccagaaaauuuggaauaucgaauaauguuaaguguacauggcucucaacauucagggaugauuguaaacgacacuggacaugaaacagaugaaaacagagcaaaaguagaaauaaccccgaauaguccuagagcagaagcaacacuagguggauuugggucauuagguuuggauugugaaccaagaacaggcuuagauuuuagugaccuauauuaccugacuaugaauaauaaacauuggcuaguacauaaagaaugguuucaugauauaccauuaccauggcacgcaggagcugauaccggaacuccacauuggaauaacaaagaagcauugguugaauuuaaagaugcucacgcaaaaagacaaaccguaguaguacuaggcucacaagaaggagcgguccauacagcacuagcaggagcacuagaagcagaaauggacggggcaaaaggaagguuaucaaguggacauuuaaaguguagacuaaaaauggacaaauuacgauuaaaaggaguaucauauucauuauguacagcagcauuuacuuuuacuaagaucccagcagaaacauugcacggaacaguaacuguagaaguucaauaugcaggaacugauggaccaugcaaaguaccugcucaaauggcuguugacaugcaaaccuuaacccccguaggacgauuaauaacagcaaauccgguuauaacagaaucaacugaaaauaguaaaaugauguuagaacuagauccaccauuuggugauaguuacauaguuauaggaguaggagaaaagaaaauaacacaucauuggcauaggagcggaucaacaauagggaaagcauuugaagcaacaguaagaggagccaaaagaauggcaguauuaggagauacggcgugggauuuuggaagcguuggaggcgcauuaaauucccuaggaaaaggaauacaucaaauauucggagcagcauuuaaaucauuauuugguggaaugucuugguuuagucaaauacuaauaggaacauuauuaaugugguuaggauuaaauacuaaaaacggaucaauaagccugaugugcuuagcacuagguggaguacuaaucuuuuugaguacagcagugucagccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10893 - RNA, 2311 nt, Artificial Sequence
  ZIKV (strain ZikaSPH2015) prME-short variant mRNA Design 3 opt
gggagaaagcuuaccauggcaauaagcggaguaccaguauuaggauuuuuuauaauagcaguuuuaauguccgcucaagagagcugggccguuacuagaagaggaagugcauauuauauguaucucgauagaaaugacgcaggagaagcgauaucauuuccaacaacauuaggaaugaauaaaugcuauauacaaauuauggaucuaggacauaugugugaugcaacaaugaguuacgaauguccaauguuagaugaaggcguagaaccugaugauguagacuguuggugcaacacaacuucaacauggguaguauacggaacgugucaucacaaaaaaggggaagcacgaagaucaagaagggcaguaaccuuaccaucacacucaacuagaaaauuacaaacuagaagucaaacauggcuagaaucaagagaauauacaaaacauuuaauucgaguagaaaacuggauauucagaaauccaggauuugcacuagcagcagcggcaauagcaugguuacuaggaucaucaacuucacaaaagguaaucuaucuaguuaugauacuucucauagcaccagcuuacaguauuagaugcauugguguaucuaaucgagauuuuguugaaggaauguccggaggaacguggguagacauaguuuuggaacauggaggauguguaacggugauggcacaagacaaaccaacaguagauauugaauuagugacaacaacaguuucaaauauggcugaagucagaagcuauuguuaugaagcaaguauaagugauauggccagugauucaagaugcccuacacagggggaagcauaucuugauaaacaaucugauacucaauaugucuguaaaagaacuuuaguugauagaggauggggcaauggauguggcuuauucggaaaaggaaguuuaguaacaugugcuaaauucgcauguucaaaaaaaaugacaggaaaaagcauacaaccugaaaaucuagaauaucguauaauguuaaguguacacggaucacaacacucaggaaugauaguuaaugauacuggacaugaaacagaugaaaacagagcaaaaguagagauuacaccaaauaguccgcgcgcugaagcaacauugggaggauuuggaagccuagguuuagacugugaaccaagaaccggucuagauuuuucagaccuauacuauuugacaaugaauaacaaacauuggcuaguucauaaagaaugguuucaugauauaccacuacccuggcacgcaggagcagauacaggaacaccucauuggaauaauaaagaagccuuaguagaauucaaagaugcacaugccaaaagacaaacaguaguaguauuaggaucacaagaaggagcuguucauacagcacucgcaggcgcauuagaagcugaaauggauggagcuaaaggacgacuaucuucuggacacuuaaaaugucgguuaaaaauggauaaauuacgauuaaaaggaguaucauauagccuauguacugcggcauuuaccuucacaaaaauaccagcagaaacacuacauggaacagucacgguagaaguacaguaugcaggaacagauggaccauguaaaguaccagcucaaauggcaguugacaugcaaacacuaacaccaguaggaagacuaauaacugcaaauccuguaaucaccgaaaguacugaaaacaguaaaaugaugcuugaauuagauccaccguuuggagauagcuauauaguaauaggaguuggagaaaaaaaaauaacccaccauuggcacaggaguggaucaacauuaggaaaagcuuuuucuacaacauugaaaggagcgcaacgucuagcugcauuaggagacacagcuugggauuuuggaucaauaggaggaguauuuaauucaauaggaagagccgugcaccaaguauucggaggagccuuuagaaccuuauucggcggaaugaguuggauaacacaaggacuaaugggagcucuauuacuauggaugggaguuaaugccagagauagauccauugcacuggccuuuuuagcgacaggagggguauuaguauuuuuagcaacaaauguacaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10894 - RNA, 2311 nt, Artificial Sequence
  ZIKV (isolate Z1106033) prME-short variant mRNA Design 3 opt
gggagaaagcuuaccauggcaauaagcggaguaccaguauuaggauucuuuauaauagcaguacuaaugucagcucaagaaaguugggccguaacaagaagaggauccgcauauuauauguaucuagauagaaaugaugcuggugaagcaauaucuuucccuaccacauuaggaaugaauaaauguuauauacaaauuauggaucugggacacacaugugaugcaacgaugucuuacgaguguccaauguuagacgaagguguugaaccagacgauguugauuguuggugcaacaccacaucaacuuggguaguauaugguacaugucaucacaaaaaaggcgaagcgagaagaucaaggagagccguaacauuaccaagucacucaacuaggaaauuacaaacaagaucacaaaccugguuagaaucaagagaauauacaaaacauuuaauaagaguagaaaauuggaucuuucgaaacccaggauuugcuuuagcugcagcagcaauagcuugguuauuaggaucaagcacaucacaaaaaguaauauauuuaguaaugauauuacuaauagcuccagcauacuccaucagauguauuggugucuccaauagagauuucguugaaggaaugagcggaggaacuuggguagauguaguuuuagaacauggcggauguguaacuguaauggcacaagauaaaccaacaguagacauagaguuaguuacaacaaccguauccaauauggcugaaguaagaagcuauugcuaugaagcuucaauaucugauauggcaagugacucaagaugcccaacacaaggugaagcauaucuagacaaacaaucagacacacaauauguauguaaaaggacacuaguagacagaggauggggaaaugguuguggcuuauuugggaaagggaguuuagucacaugcgcaaaauucgcauguucaaaaaaaaugacaggaaaaucaauccaaccagaaaaucuagaauaucguauaaugcuaucuguucauggaucucaacauagcggaaugauuguaaaugacacaggacacgaaaccgaugaaaacagagcaaaaguagaaauaacaccaaauuccccaagagccgaagcaacacuaggagguuuuggaucuuuaggacucgauugugaaccaagaacaggauuggauuucagcgaccuuuauuacuuaacaaugaauaauaaacacugguuaguacauaaagagugguuccaugauauuccauuaccuuggcacgcaggagcugauacaggaacuccacacuggaauaauaaagaagcauuaguagaauucaaagaugcacacgcaaaacgacaaacuguaguaguauugggaucacaagaaggagcagugcauaccgcauuagcuggagcacuagaggcagaaauggauggagcaaaaggccgauuaucaucaggacaucuuaaaugucgucuaaaaauggauaaauugagacuaaaaggcguaucauauucacuuuguaccgcugcuuuuacuuuuaccaaaauaccagccgaaacucuacaugguaccguaacagucgaaguucaauaugcagggacagauggaccauguaaaguuccagcacaaauggcagucgacaugcaaacauuaacgccgguaggaagguugauuacagcaaauccaguaauuacagaaagcacagaaaauucaaaaaugauguuagaauuagauccacccuuuggagauaguuauauaguaauaggaguaggagaaaaaaaaauuacacaccacuggcaccggucaggaucuacucuaggaaaagcuuuuaguacuacauuaaaaggagcacaaagauuagcagcacuaggagauacagccugggauuuuggaucuauagguggaguguuuaacuccauaggaagagcuguacaccaaguuuuuggcggugcuuuuagaacucuuuuuggugguaugucauggauaacacagggacuuaugggggcuuuacuacuguggaugggaguaaacgccagagauagaucuauagcacuagccuuucuagcaacaggaggaguauuagucuucuuagcaacuaauguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10895 - RNA, 2299 nt, Artificial Sequence
  ZIKV (strain MR 766) prME-short variant mRNA Design 3 opt
gggagaaagcuuaccauggccauaaguggaguaccuguauugggauucuuuauaauagcgguauuaaugucagcacaagaaucaugggcgauaacaagaaggggaagcgccuauuauauguacuuagauagaagcgaugcaggaaaagcaauaaguuuugcaacuacucuaggaguaaauaaaugccauguucaaauaauggauuuaggacacaugugugaugcuacaaugucuuaugaauguccgauguuagacgaaggagucgaaccugacgauguggauugcugguguaacacaacuucaacauggguaguauacggaacuugucaucauaaaaaaggugaagcgcgaagaucccgaagagcaguaacucucccuagucacucaacacgaaaguuacaaacaagaagucaaacuugguuagagaguagagaauauacaaagcacuuaauaaaaguagaaaauuggauuuuuaggaauccagguuuugcgcuuguagcaguagcaaucgcuugguuauuaggaucaucaacaucacaaaaaguaauauacuuaguaaugauauuacucauagcaccagcauacaguauaagauguauugggguaaguaaucgagauuuuguggaaggaaugagugguggaacauggguggauguaguacuugagcacggaggcugcguaacuguaauggcucaagauaaaccaacaguagauaucgaauuaguaacuacuacaguuucaaacauggcugaaguaagaucguauuguuaugaagcgagcauaucagauauggccagugacucaagaugccccacgcaaggagaagcauaucuugauaaacaaagugauacucaauauguauguaaaagaacauuaguagaccgaggauggggaaauggcuguggauuauucgguaaaggaaguuuaguaacaugcgcaaaauuuacauguucaaaaaaaaugacaggaaaaagcauucaaccggaaaaccuagaauaucgaauuauguugucgguucacggaagucagcauagcggaaugauaggauaugaaacagaugaagauagagcaaaaguagaaguaacaccaaauaguccacgugcagaagcaacucucggcggguuuggaagucuaggacuagauugugaaccaagaacaggacuagauuuuagugaucuauacuauuuaacaaugaauaauaaacauugguuaguccauaaagaaugguuucaugauauaccacuuccauggcaugcuggagcagauacaggcacaccacauuggaauaauaaagaagcucuaguagaguuuaaagacgcccaugcaaaaagacagacagugguuguacuagguagccaagaaggagcuguucauacagcauuagcaggagcccuugaagcagaaauggauggagcuaaaggaagauuauuuaguggacauuuaaaaugcagacucaaaauggauaaacuuagacuaaaagguguaucuuacagucuaugcacagccgcauuuacauuuacaaaagucccagcagagacacuacacggaacagugacaguagaaguacaauaugcaggcacugauggaccaugcaaaauacccguacaaauggcaguagauaugcaaacguuaaccccaguaggaagacuaaucacugcaaacccaguaauuacagaaaguacugagaauucaaaaaugaugcuagaauuagauccaccauucggagacaguuacauagugauaggaguaggagauaaaaaaauuacacaucauuggcauagaucagguaguacauuaggaaaagcauuuagcacaacauuaaaaggagcacaaagauuagcagcauuaggcgauacagcaugggauuuugggagcauagguggcguauucaacucuauaggcagggccgugcaucaaguauuugguggagcauucagaacucuauuuggaggcaugucauggauuacacaagguuuaaugggagcauuacuauuauggaugggaguaaaugcaagagauagaaguauagcauuagcguuuuuagcaacaggaggaguuuuaguauucuuagcaacuaauguccacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10896 - RNA, 2311 nt, Artificial Sequence
  ZIKV (strain NatalRGN) prME-short variant mRNA Design 3 opt
gggagaaagcuuaccauggcaauuucaggaguaccaguauuaggauucuuuauuauagccguacuaaugucugcacaagaaagcugggcggugacaagaaggggaagcgcauacuauauguaucuagacagaaaugaugcaggagaagcaauaucuuuuccuacaacauuaggaaugaauaaauguuauauacaaauaauggacuuaggacauaugugugaugcaacgaugagcuaugaaugcccgaugcucgacgaagguguagaaccagaugauguagauuguugguguaauaccacuagcacauggguagucuauggaacgugccaucauaaaaagggcgaagcccgaagaucuagacgagcaguaacguugccaucucauaguacaagaaagcugcaaacaagaagucaaacauggcuagaaucgagagaauauacaaaacacuuaauuagaguagaaaauuggauauuuagaaauccaggauuugcuuuagcagcugcagcaauagccuggcuauuaggaucaucaacaagucaaaaagugauauauuuaguaaugauacucuugauagcaccagccuauucaauaagauguauagguguaucaaacagggauuuuguggaaggaaugaguggaggaacuuggguagacgucgucuuagaacauggaggauguguaacaguuauggcacaagauaaaccaacaguagauauagaauuagucacaacuacuguaucuaauauggcagaaguaaggucauacugcuaugaagcaucaauuagcgauauggcuagugauaguagaugcccaacucaaggagaagcauaucuagacaaacagucagauacacaauauguaugcaaaagaacacuuguagauagaggguggggaaacggauguggacuuuuugggaaaggcagcuuaguaacaugugcaaaauuugcaugcaguaagaaaaugacuggaaaaaguauacagccagaaaaccuagaauacagaauaauguuaaguguacacggaucucaacauaguggaaugauaguaaaugauaccggacacgaaacugaugaaaaucgagcuaaaguagaaauaaccccaaacaguccgagagcagaagcaacuuuaggaggauuuggaaguuuaggacuagacugugaaccaagaacaggacuugacuuuucugaucucuauuacuuaacaaugaauaauaaacacuggcuaguacauaaagaaugguuucaugauauaccacuaccauggcaugccggugcagauacuggcacaccucauuggaauaacaaagaggcuuuaguagaauuuaaagaugcacaugcaaaaagacaaacaguaguagugcuaggaucacaagaaggugcaguacacaccgcacuagccggagcauuagaagcugaaauggauggugcaaaaggaaggcuaucaucaggacauuuaaaauguagguuaaaaauggauaaacuaagauuaaaaggaguaucauauucauuauguacugcagcauucacauuuacaaaaauaccggccgaaacgcuacauggaacuguaacaguugaaguucaauaugcgggaacagauggaccgugcaaaguaccagcacaaauggcaguagauaugcaaacucuaacaccaguuggaagauugauaacagcuaauccaguuauaacagaaaguacagaaaacaguaaaaugaugcuagaauuagauccaccguuuggagauucuuacauuguuauaggaguaggugagaagaaaauuacucaucacuggcauagaaguggcucaacacuaggaaaagcauucagcacuacacuuaaaggagcacaaagauuagcagcucuaggggauacagccugggacuucggcucaaucggaggagucuucaauaguauagggagagcaguacaccaaguauuuggaggagcauuuagaacauuauuuggagguaugagcuggauaacucaagguuuaaugggagcacuucuccuauggaugggugucaacgcaagagaccguaguauagcuuuagcuuuucuagcaacaggaggaguauuaguauucuuagcaacaaacguccaugcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10897 - RNA, 2290 nt, Artificial Sequence
  ZIKV (strain ZikaSPH2015) prME-short variant mRNA Design 3 opt
gggagaaagcuuaccauggauuggacauggauauuauuuuuaguagcagcugcaacaagaguacauaguguaacaaggcgcggaagcgcuuacuauauguaucuggauagaaacgaugcaggagaagcuauaucauuuccuaccacacuuggcaugaauaaauguuauauccaaauaauggaucuuggucauaugugcgacgcaaccaugaguuacgaaugcccaaugcuagaugaagguguagaaccugaugaugucgauuguuggugcaacacgacuucgacuuggguaguauaugguacaugucaucacaaaaaaggagaagcuagaagaaguagaagagcagucacauuaccaucacauucaacaaggaaauuacagacaagaagucaaacauggcuagaaucaagagaauauaccaaacauuuaauaagaguugaaaauuggauauucagaaauccaggauuugcauuagcagcugccgccauagcaugguuauuagggaguucaacaucacaaaaaguaauuuacuuaguuaugauucuuuuaauagcaccugcauauagcauuagauguauuggaguaaguaauagagauuuuguggaaggaaugucugguggaacauggguggauaucguacuggaacauggaggauguguaacuguaauggcgcaagauaaaccaacuguagacauagaauuaguuacaacuacaguaucaaauauggccgaaguuagaaguuauuguuaugaagcaucaauaagugauauggcaucagauaguagguguccaacacaaggagaagcuuauuuggauaaacaauccgacacacaauacguaugcaaaaggacucuaguugauagaggauggggaaauggaugcggauuauucgguaaaggaucauuaguuaccugugcuaaauucgcguguucuaaaaaaaugacagggaaaaguauucaaccagaaaaccuagaauacagaauuaugcuuagugugcauggaagccaacauucaggaaugauugucaacgacacaggucaugaaacagaugaaaaucgagcaaaaguagaaauaacaccuaauucaccacgugcagaagcaacauuaggaggauuuggaucauuaggauuagauugugaaccaaggacaggauuagauuucagcgacuuauacuaucugaccaugaauaauaaacacugguuaguacacaaagaaugguuccaugauauaccauuaccauggcacgcaggagcagacacaggaacaccacacuggaauaauaaagaggcccuuguggaauucaaagaugcacaugcaaaacgacaaacaguaguaguacuuggaucacaagagggagcaguucauacagcauuagcaggagcacuugaggcagaaauggacggugcaaaaggaagauuaaguaguggacauuuaaaauguagacuaaaaauggacaaacuaagauuaaaaggaguuagcuauaguuuauguacagcagcauucacauucacaaaaauuccagcagaaacauuacacggaacagucacaguagaaguacaauaugcaggaacagacggaccauguaaaguuccggcacaaauggcaguagauaugcaaacauuaacaccaguuggacguuuaauaacagcuaauccaguaauaacugaaagcacggaaaauucuaaaaugaugcuagaacucgauccaccuuuuggagauucuuacaucguaauaggagugggggaaaaaaaaauuacucaccacuggcauagaaguggaucaacauuagguaaagcauucaguacaaccuuaaaaggagcacaacgacuagcagcauuaggcgacacagcaugggauuuugguucgauaggaggaguguuuaauucaauaggacgcgcaguucaucaaguuuuuggaggagcauuuagaacauuauuuggaggaaugucauggauaacacagggacuuaugggagcccuauuauuauggaugggagugaaugcuagagauagaucaauagcucuagcauucuuagcaacaggugguguauuaguguuucuagcaacaaauguacacgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10898 - RNA, 2290 nt, Artificial Sequence
  ZIKV (isolate Z1106033) prME-short variant mRNA Design 3 opt
gggagaaagcuuaccauggacuggacuuggauacucuuuuuaguagcugcagcaacaagaguacacucaguaacacgaaggggauccgcauauuauauguauuuagauagaaacgaugcaggcgaagcaauuucauuuccaacaacauuaggcaugaauaaaugcuauauucaaauaauggaccuagggcauacaugcgaugccacuaugagcuaugaauguccaauguuagaugaaggaguggaaccagaugauguagacugcugguguaauacaacaaguacauggguuguauauggcacaugccaucauaaaaaaggggaagcaagaagauccagaagagcuguaacauuaccuagccauaguacaagaaaauuacaaacaagaagccaaacauggcuagaaucaagagaguauacaaaacaccuaauaagaguagaaaauuggauauuuagaaacccagguuucgcauuggcagcagcagcaauugcgugguuacuaggaucaucaacaucacaaaaaguaauauaucuaguaaugauauuauuaauagcaccagcuuauucaauaagauguauaggcguaaguaauagagauuuuguagaaggaaugagcggaggaacauggguggauguaguauuagagcauggaggauguguaaccguaauggcacaagauaaaccaacaguugauauagaguugguuacuacaacuguuucaaauauggcagagguacguucuuacugcuaugaagcaaguaucagcgauauggcaagugacucacguugcccaacucagggggaggccuauuuagacaaacaauccgauacacaauauguuuguaaaagaacacuaguagacagaggauggggaaacggaugugguuuauuuggaaaaggcaguuuagucacuugugcaaaguucgcauguaguaaaaaaaugacagguaaaagcauccaaccagagaaccuagaauacagaauaauguuaaguguucacggaucucaacauagcggaaugauugugaacgauacuggucaugaaacggaugaaaauagagcuaaaguagaaauuacaccaaauagucccagagcagaagcaacccuaggcggauucggaucauugggacuugacugcgaaccuagaaccggacuugauuuuucugacuuguacuacuuaacaaugaauaauaaacacugguuaguucauaaagaaugguuccaugauauaccacugccauggcacgcaggagcagauacugguacaccucauuggaauaauaaagaagcauuaguugaauucaaagacgcacaugcaaaaagacaaacaguaguaguauuaggaagccaagaaggagcaguacacacagcacuagcaggagcuuuggaagcagaaauggacggugcuaaaggaagauugagcaguggacaucuaaaaugucgacuuaaaauggauaaauuaagauuaaaagguguaagcuauucacuauguacugcagcauucacauuuacgaaaauaccagcagaaacucuacacgguacaguuacaguagaaguccaauaugcaggaacagauggaccauguaaaguucccgcacaaauggcaguggacaugcaaacauuaacuccgguuggaagauuaauaacugcaaauccagugauuacggaaucgacagaaaauucaaaaaugaugcuugaauuagacccuccuuuuggagauucauacauaguaaucgguguaggugaaaaaaaaauuacacaucauuggcaucggucagguucaacuuuagggaaagcauuuucgacaacacuaaaaggcgcacaaagauuagcagcacuaggcgacacagcaugggauuucggaaguauaggaggaguuuuuaauagcauaggaagagccguacaucaaguauuuggaggagcuuuucggacucuauuuggaggcaugucauggauaacacaagguuuaaugggggcauuauuauuauggaugggaguuaaugcacgugauagaagcauagcguuagcauuuuuagcaacuggaggaguauuaguauucuuagcaacaaacguacaugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10899 - RNA, 2278 nt, Artificial Sequence
  ZIKV (strain MR 766) prME-short variant mRNA Design 3 opt
gggagaaagcuuaccauggacuggacauggauacuauuucuaguagccgcagcgacuagaguacauucaauuacaagaagaggaagcgcauauuauauguauuuagauaggucagaugcugggaaagcaauaucauucgcaacuacuuuggguguaaacaaaugccacguacaaauaauggaucuaggccauaugugugaugcaacaaugucauaugaauguccaauguuagacgaagguguagaaccagaugauguugauugcugguguaacacaaccucaaccugggugguuuaugguacuugucaccacaagaaaggugaagcuagaaggaguaggagggccguaacacuuccaucacauagcacaagaaaacuucaaacuagaucacaaacaugguuagaaucaagggaauacacaaaacaucuaaucaaagucgaaaauuggauauuuagaaacccaggauuugcucuaguugcaguagccauagccuggcucuuaggaucaagcacuucacagaaaguuauauauuuaguuaugauacuauuaauagcacccgcuuauuccauaagauguauaggagugaguaaucgagacuuuguagaaggaaugucaggugguacguggguggauguaguauuagaacauggaggauguguaacaguuauggcacaagacaaaccaacaguagauauagaauuagucacaacaacaguaucaaauauggcagaaguuagaucauauugcuacgaagcgucaauaagugauauggccucagauaguagauguccuacacaaggagaagcguauuuagacaaacaaucagacacacaauauguuuguaaaaggacucuaguugauagaggaugggguaauggauguggauuauucggaaaaggaucccuaguaacaugugccaaauuuacauguaguaagaaaaugaccggaaaaucuauacagccagaaaauuuagaauaucguauaauguuaagcguacaugguagucaacacagcgguaugauaggguaugaaaccgacgaagacagagcaaaaguagaaguaacaccaaacucaccaagagcugaagccaccuuaggaggauucggaagucuuggauuagauugugaaccaagaacuggauuagauuucucagaccuuuauuauuuaacuaugaauaauaaacauugguuaguacauaaagaaugguuucacgacauaccuuuaccauggcaugcaggagcagauacaggaacgccacacuggaacaauaaagaagcauuaguagaauuuaaagaugcucacgcuaaaagacaaacaguuguaguauuagggucacaagaaggugcuguacauacugcauuagcaggagcacuagaagccgaaauggacggagcaaaaggcagauuauuuaguggacaucuuaaaugcagauuaaaaauggauaaacuaagacuaaaaggaguaagcuacagccuauguacugccgcauuuacauuuacaaaaguuccagcugaaacacuacaugggacaguaacaguagaaguccaauacgcaggaacugauggaccauguaaaauaccaguacaaauggcaguagacaugcaaacacuuacaccaguugggagguuaauaacagcuaaucccguaaucacugaaucaacagaaaauaguaaaaugauguuagaacuugacccaccauuuggagauucauacauuguaauuggaguaggugauaagaaaauaacacaucauuggcauagaucuggaucaacacuuggaaaagcauucagcacaacauugaaaggagcacaaagauuagcggcauugggggauacagcaugggauuucggaaguauaggaggaguauuuaauucaauuggucgagcaguccaccaaguauuuggaggagccuuuagaacauuauucggaggaaugucauggauuacacaaggauuaaugggagcccuauugcuuuggaugggaguuaaugcacgagaccguucgauagcucucgcauuucucgcuacuggcggaguucuaguauuuuuagcaacgaauguucaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10900 - RNA, 2290 nt, Artificial Sequence
  ZIKV (strain NatalRGN) prME-short variant mRNA Design 3 opt
gggagaaagcuuaccauggauuggacauggauucuauuucuuguagcagccgcaacaaggguacauagugucacaagaaggggaagugcauauuauauguaucuagacagaaaugaugcuggugaagccauaaguuuuccaacaacgcuaggaaugaauaaauguuacauccaaauaauggaucucggccauaugugugaugcgacaaugaguuaugaaugcccaaugcucgaugaagggguagaaccagaugauguagauuguugguguaauacaacaucaacuuggguaguuuauggaacaugucaucauaaaaaaggugaagcuagaagaucgaggagagcuguaacuuuaccuucucauagcacaagaaaauuacaaacaagaagccaaacuugguuagaaagcagagaauacacaaaacauuuaauuagaguagaaaauuggauauuucgaaauccaggauucgcauuagcugcagcagcaauagcauggcuucuaggcuccaguacaucucaaaaagugaucuauuuaguaaugauacuucuaaucgcaccagcauacaguaucagaugcaucgguguaucaaauagagauuuuguugaaggaaugucgggcggaacauggguagacgucguacucgagcauggcggcuguguaacaguaauggcacaagacaaaccaacaguugauauagaauuaguuacaacuacgguaaguaauauggcagaaguuaggagcuacuguuaugaagcaucaauaucagauauggcaucagauucaaggugcccaacgcaaggagaagcauauuuagauaaacaaagugacacucaauacguauguaaaagaacauuaguugauagaggauggggaaacggaugugguuuauuuggaaaaggaagcuuaguaacaugugcaaaauuugccuguucaaaaaaaaugacaggaaaaaguauacaaccagaaaaucuagaauaccguauaaugcuaucaguacauggaagucaacacagcgggaugauaguaaacgacacaggacacgaaacagaugaaaaucgugcaaaggucgaaauuaccccaaacagcccaagagcagaagcaacucuuggagguuucggaucauuaggacuagauugcgagccaagaaccgguuuagauuuuagcgauuuauacuauuuaacaaugaauaauaaacauugguuaguucauaaagaaugguuucaugauauaccacuaccauggcaugcaggugcggauacuggaacaccucauuggaacaauaaagaagcacuaguagaauucaaagacgcacaugcuaaaagacaaacaguugucguauuaggaagucaagaaggagccguacauacugcacuagcaggugcguuagaagccgagauggauggagcaaaaggccgacuuaguagcggucauuuaaaaugcagauuaaaaauggauaaauugagacugaaaggugugucauauucacuauguacugcagcauuuacauucacaaaaauaccugcagaaacacuacacggaacugucacaguagaaguacaauacgcagguacagaugguccauguaaaguaccagcucaaauggcuguagacaugcaaacauuaacaccaguuggaagacuaauaacagcaaaucccguaauaacugaaagcacagaaaauucaaaaaugauguuggaacuugauccaccauuuggcgauaguuacauaguaauaggaguuggagaaaaaaaaauaacacaucauuggcacagaaguggaagcaccuuaggaaaagcuuuuucaacaacauuaaaaggagcacaaagauuagcagcauuaggugacacagcaugggauuuuggcucaauuggugguguauucaauaguauagggagagcaguacaucaaguuuucggcggagcauuuagaaccuuauuuggcggaaugaguuggaucacucaaggacuaaugggagcacuauuacucuggauggguguaaaugcaagagauagaagcauagccuuagcauuucuugcuacaggaggaguauuaguauuccuagcuaccaauguacaugcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10901 - RNA, 2308 nt, Artificial Sequence
  ZIKV (strain ZikaSPH2015) prME-short variant mRNA Design 3 opt
gggagaaagcuuaccaugggcaaacguagugcaggaucgauaauguggcuagccucauuagcaguaguaauagcaugugccggagcaguaacgaggcgcggaucagcuuauuauauguaccuagacagaaaugaugcaggagaagcaauaucauucccuacaacacuuggaaugaauaaauguuauauacaaauaauggauuuaggacauaugugcgacgcaacuaugaguuacgaaugcccaaugcuugaugaaggcguagaaccagaugauguugauugcuggugcaacacaacgucaaccuggguaguguaugggacaugucaucacaagaaaggagaagcuagaagaaguagacgagcaguaacguuaccgagucauaguacgagaaaauuacaaacacgaucacaaacaugguuagaaagcagagaguacacaaaacauuuaaucagagucgaaaauuggauuuucaggaauccuggguuugcauuagcagcagcggcaauagcaugguuauuaggaucaaguacaucacaaaaaguaaucuaucuaguaaugauucuguuaaucgcucccgcauauuccauuagauguauaggaguaucaaacagagauuuuguggaaggaauguccggaggaacauggguagauauaguuuuggaacauggaggguguguaacagucauggcacaggauaaaccaacgguggauauagagcuaguaacaacaacaguaucaaauauggcagaaguaagaucuuauuguuaugaagcaucuauaagugauauggccagugacaguagauguccaacacaaggggaagcauaucuagacaaacaaagugauacacaauacguauguaaaagaacacuuguagauagaggauggggaaauggaugcggauuauucggaaaaggaucuuuaguaacaugcgcaaaauucgcaugcucaaagaaaaugacagguaaaaguauucaaccagaaaaucucgaauauagaauuauguuaaguguucauggaucacaacacagugguaugauaguaaacgauacagggcaugaaaccgaugaaaacagagcaaaaguagaaauaacaccuaauucaccuagagcagaagcuacucugggaggauucgggagucuuggacuagauugcgaaccaagaacaggucuugauuuuucugaucuauauuaucucacaaugaauaauaaacauugguuaguucacaaagaaugguuucacgacauaccguuaccauggcaugccggagcagauacgggaacuccacauuggaauaauaaagaagcucuuguagaauuuaaagaugcucaugcaaaaaggcaaacaguaguaguuuuaggcagccaagaaggagcaguacacacagcuuuagcuggagcauuagaagcagaaauggauggagcgaaaggaagacuaucgucaggucauuugaaaugcagacuuaaaauggacaaauuaagacuaaaaggaguuucauauucauuauguacugcagcauucacuuuuacaaaaauaccagcagaaacacuacauggcacaguaacuguagaaguacaauaugcuggaacagacggaccaugcaaagucccugcccaaauggcaguggauaugcaaacacuaacaccagugggaagacuaauaacagcaaauccaguaauaacagaaucaacagaaaacucaaaaaugauguuggaauuagauccaccuuuuggagacaguuauauuguaauaggcguaggagaaaagaaaauuacacaccauuggcauagaaguggaagcacacuuggaaaagccuuuagcacaacauuaaaaggagcucaaagauuagcugcacuaggagauacagcgugggauuuuggaaguauaggaggugucuuuaauaguaucggcagagcaguacaucaaguauucggaggagcauucagaacacuauuuggcggcaugucauggauuacacaagguuuaaugggagcucuauuauuauggauggguguaaacgcuagggaucggaguauugccuuagcuuuucuagcaacaggagguguguuaguauuuuuagcaacgaacgugcacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10902 - RNA, 2308 nt, Artificial Sequence
  ZIKV (isolate Z1106033) prME-short variant mRNA Design 3 opt
gggagaaagcuuaccaugggaaaacgaucagcaggaucuauaauguggcucgcaucauuagccguaguuauagcaugugcuggagcaguaacaagacgagguagcgcauacuauauguaucuggauagaaaugaugcgggagaagcuauaucguuuccaacaacacuagguaugaauaaauguuauauacaaauaauggauuuaggacauacaugugaugcaacaaugucauaugaauguccaaugcuagacgaaggaguugaaccagacgacguagacugcugguguaauacaacaaguacuuggguagucuauggaacgugccaucauaaaaaaggugaagcaagaaggucccgaagggcaguuaccuuacccagucauucaacuagaaaacuucagacaagaucacaaaccuggcuagaaucacgagaguauacaaaacauuuaauaagagucgaaaacuggauauuuagaaauccuggauucgcacuagccgcagcugcaauagcauggcuccuaggauccuccacaagucaaaaaguaauauauuuaguaaugauccuacucauugcaccagcauauucuauaagguguaucggaguaagcaaucgagacuuuguugagggaaugaguggcgguacauggguagauguuguacuagaacacggcggcugcguaacaguaauggcucaagauaaaccuacaguagauauagaauuaguaacuacuacaguaucuaacauggcagaaguaagaucuuacuguuaugaagccucaauaagcgauauggccucagauucaagauguccaacacaaggagaagcauacuuagauaaacaaucugauacacaauacguaugcaagagaacacuaguagauagaggaugggguaaugguuguggauuauucggaaaaggaagccuaguaacuugugcaaaauuugcauguaguaaaaaaaugacgggaaaaaguauccaaccugaaaauuuagaauauagaauaaugcuaucaguucauggcagucaacauagcggaaugauuguaaaugauacaggucaugaaaccgacgaaaacagagcaaaaguagaaauuaccccaaauaguccuagagcagaagccacuuuaggaggcuuuggaucccuaggucuugauugugaaccaagaacaggauuagauuuuucggacuuauauuaccuuacaaugaauaauaaacacuggcuaguucauaaagaaugguuccaugacauaccuuuaccuuggcaugcaggagcagacacuggcacaccacacuggaacaauaaagaagcgcucguagaauucaaagacgcccaugcaaaaagacaaacuguuguaguauugggaucacaagaaggcgcuguacauacagcauuagcaggagcucuugaagcagaaauggauggagcgaaaggaagacuaucaucggggcacuuaaaaugcagauuaaaaauggauaaguuacguuuaaaagggguuagcuacucucuuugcacagcagcauuuaccuuuacaaaaauaccagccgaaacacuacacgguaccguaacaguagaagugcaauaugcuggaacugaugguccauguaaaguaccugcacagauggcuguagauaugcaaacacuaacgccaguaggaagauuaauaacagcaaauccaguaauaacugaaucaacagaaaacucaaaaaugauguuggaacuagauccaccauuuggagauaguuauauaguaauaggaguaggagaaaaaaaaauaacucaccacuggcauagaucagguaguacguuagguaaagcauuuucgacaacauuaaaaggagcacagagauuagcugcacuuggagauacggcuugggauuucggaucaauaggaggaguauuuaauaguauuggaagagcgguacaucaaguuuuugguggagcauuuagaacccuauuuggaggaaugucuuggauuacacaaggacuuaugggagcauuauuauuauggaugggaguaaacgcucgagacagaucaaucgcauuagcauuuuuagcgacaggaggaguacuaguauuucucgcaacaaacguacacgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10903 - RNA, 2296 nt, Artificial Sequence
  ZIKV (strain MR 766) prME-short variant mRNA Design 3 opt
gggagaaagcuuaccaugggaaaaagaagugcaggaucaauaaugugguuagcaucacuggcgguaguuauagcaugcgcaggagcuauaacaaggaggggaucagcauacuauauguauuuagacaggagugaugcaggaaaagcaaucucauuugcaaccacacuagguguaaauaaaugucauguccaaauaauggaccuaggucauaugugugaugcuacaaugucguaugaaugcccaaugcuugacgaagguguggaaccagaugacguagauugcuggugcaacacaacaagcacauggguaguuuaugggacaugucaccauaagaaaggugaagcacgaagaucacggcgagcaguaacuuuaccaucacauucaacaaggaaacuacaaacaagaucacaaacaugguuagaaucaagagaguauacaaaacaucuaauuaaagucgaaaauuggauauuuagaaauccuggauuugcccuaguugcaguugcaauagcuuggcuucuuggaagcucaacaucccaaaaaguaauuuauuuaguaaugauacuacugaucgcuccugcauacaguauaagauguauaggaguaaguaauagagacuucguggaaggaauguccggagguacuuggguugauguaguauuagaacacgguggaugcguaacaguaauggcacaagauaaaccuacaguagacauagagcuaguaacaacaacuguaucgaauauggcugaaguuagauccuauuguuaugaagcaaguauaucggauauggcaucagacaguagauguccaacacaaggagaagcauacuuagauaaacaaagcgauacacaauauguauguaaaagaacauugguugauagaggauggggaaauggauguggauuauucggaaaaggaagucuaguaacuugugcaaaauucacguguucaaagaaaaugacaggaaaaucaauacagccggaaaaucuagaauauagaauaaugcuaucaguccauggaagccagcauucaggaaugauaggauacgaaacagaugaagauagagcaaaaguagaaguaacuccaaauucaccaagagcagaagcaacuuuaggcgguuuugguuccuuagguuuagacugcgaaccaagaacaggauuagauuuuucagauuuguacuaccuaacuaugaacaauaaacauuggcuaguucauaaagaaugguuucaugacauuccauuacccuggcaugcuggagcagacacaggaacuccacauuggaauaauaaagaagccuugguagaguuuaaagaugcacacgcaaaaaggcagacuguaguaguauuaggcucucaggaaggggcgguacacacagcauuagcaggagcauuagaagcagaaauggauggagcgaaggguagauuauuuaguggccauuuaaaguguagauuaaaaauggauaaauuaagauuaaaaggaguaucauauagucuuuguacagcagcuuucacauuuacuaaagugccagcagaaacauuacauggaacaguaacaguugaaguacaauaugcuggaacagauggaccauguaagauaccaguccagauggcaguagacaugcaaacucuaacaccagucgggagauuaauuacugcaaacccgguaauaacagaaagcacagaaaacagcaaaaugauguuagaauuagacccaccauuuggugacaguuauauaguaauagguguaggagacaagaaaauuacucaucacuggcaucgaaguggaagcacucuagguaaagcauucucuacaacacuaaaaggagcacaaaggcuagcagcacuaggugacacagcaugggacuuuggauccauaggaggaguuuuuaacucaauagguagagcugugcaucaaguauucggaggagcauuucguacuuuauucggaggaaugaguuggaucacacaaggauuaaugggagcacuauuauuauggaugggagucaaugcaagagauagaucaauagcacuagcauuuuuagcaacuggaggaguguuaguauuucuagcuacuaauguacacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10904 - RNA, 2308 nt, Artificial Sequence
  ZIKV (strain NatalRGN) prME-short variant mRNA Design 3 opt
gggagaaagcuuaccaugggaaaaagaucagcaggaaguauaaugugguuagcaagucuagcaguaguaauagcaugcgcaggagcuguaacgcgaaggggaucagcauauuauauguauuuagauagaaaugacgcaggagaagcaauaucauuucccacuacauuaggaaugaacaaauguuauauacaaauaauggacuuaggacauaugugugaugcaacaaugucauacgaauguccaauguuagacgaaggcguagaaccagaugauguagauugcuggugcaauacuacaaguacauggguagucuacggaacaugucaucauaagaaaggagaagccagaagaagcagacgagcaguuacacuaccaucacauaguacgagaaaauuacaaacaagaucacaaaccuggcuagaaaguagagaauauacaaaacauuuaauaagagucgaaaauuggauauuuagaaauccaggauuugcauuagcagcggccgcaauagcauggcuacuugguucuucaacaucacaaaaaguaauauauuuaguaaugauuuuacuaaucgcaccagcauacucaauaagauguauaggcguaagcaacagagauuuuguagaagggaugaguggaggaacuuggguagauguuguauuagaacacggcgguugcgucacaguaauggcacaagacaaaccaacaguagauauagaauugguaacaacaaccguaaguaauauggcagaaguaagaucauauuguuacgaagcaucaauaagugauauggcuucagauucaagauguccuacucaaggagaggcuuacuuagacaaacaaucagacacucaauacgucuguaaaagaacacucgucgauagaggaugggguaauggaugcggacuauuuggaaaaggaucauuaguaacaugugcaaaauucgcaugcaguaagaaaaugacaggaaaaagcauacaaccggaaaaucuugaauacagaauaaugcuuucaguucauggaucacaacauaguggaaugauagucaaugauacaggucaugaaaccgaugaaaauagagcaaagguagaaauaacaccgaacaguccaagagcagaagcaacacucggaggauuuggaucauuagguuuagauugugaaccaagaacgggacuagauuuuagcgauuuauauuaccuaacuaugaauaauaaacauugguuaguacauaaagaaugguuucaugauauaccuuuacccuggcaugcaggagcagauacuggaacuccucauuggaauaauaaagaagcauuaguagaauuuaaagacgcacacgcuaaaaggcaaacaguugugguuuuaggaagucaggaaggagcaguacacacagcauuagcgggagcauuagaagccgaaauggacggagcaaaaggccgauuaucaucaggacaucuuaaauguagacuaaaaauggauaaacuaagauuaaaaggaguuucuuauucauuguguacagcagcauuuaccuuuacaaaaauaccggcugaaacuuugcacggaacggugacaguagaaguacaauaugcagguacagacgguccuuguaaaguaccagcccagauggcaguagacaugcaaacacuaacgccaguagguagauuaaucacagcaaacccaguaauaacggaaagcacagaaaauucuaaaaugauguuagaauuagauccaccuuucggagacucauauauagucauaggagugggugagaaaaagauaacacaccauuggcacagaagcggaaguacauuaggaaaagcauucucaacaacacuaaaaggagcacaacgucuagcugcauugggugauacugcaugggauuuuggcagcauagguggaguauuuaauagcauugguagagcugugcaucaaguuuucggaggagcauuccgaacauuauuuggcggaaugucauggauaacacaaggauuaaugggagcacuauuauuauggaugggaguuaaugcaagagauaggaguaucgcacuagcauucuuagcaacaggaggaguauuaguguuuuuagcaacuaauguacacgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10905 - RNA, 2011 nt, Artificial Sequence
  ZIKV (strain ZikaSPH2015) ME variant mRNA Design 3 opt
gggagaaagcuuaccaugacaucaguuggaauaguaggccuacuuuuaacaacagcaauggcagcaguuacauuaccaagucauaguacaagaaaacuacagacaagaagccaaacaugguuagaauccagagaguacacuaaacauuuaaucaggguagaaaauuggauauuuagaaauccaggauuugcacuagcagcagccgcaauagcauggcuauuaggaucuucuacaucacaaaaaguaauuuauuuaguaaugauacuauuaauagcaccugcuuauaguauaagguguauuggaguuucaaaucgagacuuuguugaaggaauguccgguggaacauggguagacauaguauuagaacauggcgguuguguaacuguaauggcgcaagauaaaccaacuguagauauagagcuaguaaccaccacaguaaguaauauggcagaaguuagaaguuauuguuaugaagcgucaauaagugacauggcaagugauagccgauguccaacucaaggcgaagcauauuuagacaaacaaucagauacucaauauguuugcaaaagaacauuaguagauagagguuggggaaauggcuguggauuauuugguaaaggaucauuaguaacuugcgcaaaauuugcauguucaaaaaaaaugacaggaaaaucuauacaaccagaaaaucuagaauacagaauaaugcuaaguguacacggaucccaacauucaggaaugauuguaaaugauacuggacaugaaacagaugaaaauagagcaaaaguagaaauuacaccaaacucaccucgagcagaagcaacauuaggcgguuuuggaucuuuaggauuagauugcgaaccacguacagguuuagauuucucagaucucuauuaucucaccaugaauaauaaacauuggcuaguacauaaagaaugguuucaugauauuccauuaccauggcacgcgggggcagauacaggcacuccacauuggaacaauaaagaagcauuaguagaauuuaaagacgcccaugcuaaaagacaaacaguuguaguacuaggaagccaagaaggagccguacauacagcauuagcuggggcacuagaagcagaaauggauggagcaaaaggaagauuaaguucuggucaucuaaaauguagauuaaaaauggacaaacuacgauuaaaagguguuagcuauagcuuauguacagcagcauuuacauuuacaaaaauaccugcagaaacuuuacauggaacaguaacagucgaaguacaauacgcaggaacagauggcccauguaaaguuccagcacaaauggccguagacaugcagacauuaacacccguaggaagauuaauuacugcaaauccaguaauaacggaauccacagaaaacucaaaaaugauguuagagcuugacccaccguuuggagauaguuauauagugauaggaguaggagaaaaaaaaauaacucaccauuggcacagaagugguucuacaauaggaaaagcauucgaagcaacggucagaggugcaaaaagaauggcuguauuaggagacacagcaugggacuuuggcagcguaggaggagcacuaaacucauuaggaaaaggaauacaccaaauuuucggagcggcauucaaaagucuuuuuggaggaaugucuugguuuucacaaauauuaauaggaacacuacuaaugugguuaggacuaaauacaaaaaauggaucaauaucccugaugugccuagccuuaggaggcguacuaauauuuuuauccacugcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10906 - RNA, 2011 nt, Artificial Sequence
  ZIKV (isolate Z1106033) ME variant mRNA Design 3 opt
gggagaaagcuuaccaugacaagcguaggaauaguaggauuauuauuaacaacagcaauggcugcugucacccuaccaagucauaguacaagaaaacuacaaacuagaucacaaacauggcuagaaagucgagaauauaccaaacauuuaauaagaguggaaaauuggaucuuuagaaauccaggauuugcucuggcugcagcggcaauagcaugguuacuuggaucaaguacaucacaaaaaguaauauauuuaguuaugauauuacuuauagcaccagccuauaguauacguuguauaggcguuagcaauagagauuuugucgaaggaaugagcggaggaacauggguagacguaguacuagaacauggaggauguguaaccguaauggcacaagacaaaccuacgguggauauagaauuaguaacgacaacaguaucuaauauggcagagguacgaagcuacuguuaugaagcaaguauaucagauauggcaagugauagcagauguccaacacaaggagaggcauaccuagauaaacaaagugauacacaauaugugugcaaaagaacccuaguagaucgaggcuggggaaauggcugugguuuauuugguaagggaucauuaguaacaugugcaaaauuugcaugcucuaagaaaaugacaggaaaaucaauacaaccugaaaaucuugaauauagaauaauguugaguguacauggaucucaacauagcggaaugauugugaaugacacaggacacgagacagaugaaaauagagcuaaaguagaaauaacaccaaauucaccaagagcagaagcaacauuaggaggauucggaucguuagguuuagauugugaacccagaaccggauuagauuuuagcgauuuauauuaccuaacaaugaacaauaaacauugguuaguacauaaagaaugguuucaugauauucccuuaccuuggcaugcuggagcagauacaggaacaccacacuggaacaauaaagaagcauuaguagaauuuaaagaugcacacgcaaaaagacaaacugugguaguacuaggaagucaagaaggugcaguacacacagcauuagcaggagcauuagaagcagaaauggacggagcuaaaggaagauuaucuucaggacaccuaaaguguagauuaaaaauggacaaacugagacuaaaagguguaaguuauaguuuauguaccgcagcuuuuacauuuacaaaaauaccagcagaaacacuacacggaacaguaacggucgaagugcaauaugcaggaacagauggaccaugcaaagugccagcacaaauggcgguagacaugcaaacauuaacaccaguaggaagauuaauuacugcaaauccaguuauaaccgaaagcacagaaaacucaaaaaugauguuagaacuagauccaccuuuuggagauaguuauauaguaauaggaguaggugaaaagaaaaucacacaccauuggcauagaaguggcucaacaauaggaaaagcauucgaagcaacaguaagaggggcaaaaagaauggcuguacuaggagauacagcaugggauuuuggaucagucggaggagcauuaaacagcuugggaaaaggaauacaucaaauauuuggagcugcauuuaagaguuuauucggcggaaugaguugguuuagucaaauauuaauaggaacuuuacucaugugguuaggguuaaaugccaaaaauggcucgauuagucuaauguguuuagcuuuaggaggaguauuaauauuucuaagcacagcggucucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10907 - RNA, 1999 nt, Artificial Sequence
  ZIKV (strain MR 766) ME variant mRNA Design 3 opt
gggagaaagcuuaccaugacaaguauaggaauaauaggacuacuauuaacaacagccauggcagcaguaacacuaccuucacacucgaccaggaaacuacaaacccgaagucaaaccugguuagaaaguagagaauacacuaaacaucuaauaaaaguugaaaauuggauauuuagaaauccaggauuugcuuugguugcaguugcuauagcauggcuauuaggaagcagcacaucucaaaaaguuauuuaucuaguuaugauacucuuaauagcuccugcauauaguauacgcuguauaggaguaucaaauagagauuuuguagaaggaaugucaggaggcacauggguagauguuguacuagaacacgguggauguguaacaguaauggcacaagauaaaccaacgguagacauagaauuaguaacaacaaccguaaguaauauggcagaaguacgaucauacugcuaugaagcaucaauaagcgacauggcaagugauucuagaugcccaacacaaggugaagcauaucuagauaaacaaucugacacgcaguauguauguaaacgcacgcuaguagauagaggaugggguaacgguuguggucuauuugguaaaggaucucuuguaacaugcgcaaaauucacauguucuaagaaaaugacaggaaaaagcauucagccagaaaaucuagaauacagaauaaugcuaucuguucauggaucucaacauuccgguaugauaggauaugaaacugaugaagauagagcuaaaguagaaguaacaccaaauaguccaagagcugaagcaacacuaggaggcuucgguaguuuaggguuagauugugaaccgagaacaggacuugacuuuagugaccuauauuaucuuacaaugaacaauaaacauugguuaguccauaaagaaugguuccacgauauaccacuaccauggcaugcuggugcagauacaggaacaccacacuggaauaauaaagaagcucuaguagaguucaaagaugcacaugcaaaaagacaaacaguaguaguacuaggaagucaagaaggggcaguacauacagcauuagcaggagcauuagaagcagaaauggacggagcaaaaggacgucucuucuccggacaccuaaaaugcaggcuaaaaauggacaaauuaagguuaaaaggaguaucuuauucacuuuguacagccgcauucacauuuacaaaaguaccagcagaaacacuacauggaacuguaacaguugaaguucaauaugcuggaacagauggaccauguaaaauaccuguacaaauggcaguagauaugcaaacuuuaacaccaguagguagauuaauaacagcaaacccuguuauaacagaaaguacagaaaacagcaaaaugaugcuagaacuagacccuccauucggagacucuuacauaguaauuggaguaggagacaagaaaauaacacaucauuggcaccgaucuggcucaacaauaggaaaagcauuugaagcaacaguaagaggagcaaaaagaauggcaguauuaggagauacugccugggauuuuggaucaguaggaggaguauucaauagcuuaggcaaaggcauacaucaaauauuuggugcugcauucaaaaguuuauuugggggaaugucaugguuuucacaaauucuaauaggaacacuauuaguauggcuaggauuaaacacgaaaaauggaagcauuagucuaacaugucuagcucuagguggaguaaugauauuccuaucaacagcaguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10908 - RNA, 2011 nt, Artificial Sequence
  ZIKV (strain NatalRGN) ME variant mRNA Design 3 opt
gggagaaagcuuaccaugacaucaguaggaauagucggauuauuauuaacaacagcaauggccgcaguaacauuaccaagccauaguacuagaaaauuacaaacacgaagccaaacaugguuggaaucaagagaauacacaaaacaucuuauaagaguggaaaauuggauauucagaaauccaggauuugcacuagcagcagcagcuauagcauggcuucuaggcaguaguacaucacaaaaagucauuuauuuaguaaugauauuacuuauagcuccagcauauucuauucguuguauaggaguaucaaacagagacuuuguugaaggaaugaguggaggaacuuggguagauguaguuuuagaacaugguggauguguaacaguaauggcacaagauaaaccuacaguagauauagagcuaguuacaacaacgguaucaaauauggccgaaguaaggaguuauuguuaugaagcaucaauaucagauauggcaucagauaguagauguccaacacagggcgaagccuaucuagauaaacaaucagacacacaauauguauguaaaaggacacugguggauagaggauggggcaacggauguggcuuauuuggaaaagguaguuuagucacaugugcaaaauuugcauguucuaagaaaaugacagguaaaucuauccaaccagaaaaucuagaauauagaauaaugcuuagcguucauggaagucaacacagugguaugauugugaaugauacuggacaugaaacagacgaaaauagagcaaaaguagaaauaacaccaaacucacccagagcugaagcaacacuaggaggauucggaucacuuggacuagauugugaaccuagaacuggacuugauuucagugauuuauacuacuuaacuaugaauaauaaacauugguuaguacauaaagaaugguuccacgacauuccacuaccuuggcaugcuggugcagauacaggaacgccacauuggaauaauaaagaagcacucguagaguucaaagaugcacaugcaaaacgacaaacgguaguuguauuaggaagucaagaaggcgcaguccauacagcauuagcuggagcacuagaagcugaaauggauggagcaaaagguagauuaaguuccggacaccuaaaauguagacuaaaaauggauaaauuaagacugaaagguguaagcuauagucugugcaccgcugcauuuacauucacaaaaauaccugcugaaacauuacauggaacaguaacaguugaaguacaauaugcaggaacagacggaccuugcaaaguacccgcacagauggcuguagacaugcaaacauuaaccccagugggaagacuaauaacagcaaauccaguaauaacagaaagcacugaaaauucaaaaaugauguuagaacucgauccaccauuuggggauagcuauauaguaauaggaguaggcgaaaagaaaauaacacaccacuggcauagaagugguaguaccauuggaaaagcauuugaagcuacagucagaggagcaaaaagaauggcaguacuuggcgauacagcuugggauuuugguucuguaggcggagcuuuaaacaguuuaggaaaaggaauacaucaaaucuuuggagcagccuuuaaaaguuuauuuggaggaaugaguugguuuucccaaauuuuaauaggaaccuuauuaauguggcuagguuuaaauacgaaaaaugggagcaucagcuuaaugugucuagcacuuggugggguauuaauauuucuaagcacagcgguaucugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10909 - RNA, 2038 nt, Artificial Sequence
  ZIKV (strain ZikaSPH2015) ME variant mRNA Design 3 opt
gggagaaagcuuaccauggccauaagcggaguaccaguauuaggauucuucauaaucgcaguacuaaugagugcacaagaaaguugggcagcagugacauuaccaagucacaguacaagaaaauuacaaacacguagucaaacaugguuagaaagucgagaauauacaaaacaucuaauacguguagaaaacuggauauuuagaaauccaggauuugcuuuggcagcagcugccauagcauggcuucuaggaagcucaacaucacaaaaaguuauauaucuagucaugauucuucuaaucgccccugcauauucaauaagauguauaggagucucaaacagagauuucguagaaggaaugucaggaggaacauggguagacauaguccuugaacacggaggauguguaacuguuauggcccaagauaaaccuacuguagauauagaauuggucacaacuacaguaagcaacauggcagaaguaagaucauauuguuaugaagcuagcauaucagauauggcaucagauucaagaugcccaacacaaggugaagcauaucuagauaaacaaucagauacacaauacguauguaaacgaacauuaguagauagaggauggggaaauggauguggacuuuuuggaaaaggaucauuaguaacaugcgccaaauuugcguguucaaagaaaaugacuggaaaaucaauacaaccggaaaaccuagaauauagaauaauguuaaguguucauggaucacaacauucagguaugauaguuaaugauacaggacaugaaacagaugaaaacagagcaaaaguagaaauaacaccaaauucaccaagagcagaagcaacauuaggcgguuucggaaguuuaggacuugauugugaaccuagaacagguuuagauuuuucagaccuauauuauuugacaaugaauaacaaacacugguuaguacacaaagaaugguuccaugauauaccacuaccauggcaugcuggugcggauacaggaacuccccauuggaauaauaaagaagcguuaguagaauuuaaagacgcacacgcaaaaagacaaacuguaguaguauugggaucucaagaaggagcaguacacacugcauuagcaggagcacuagaagcagaaauggauggagcuaaaggcagacuuagcaguggacauuuaaaaugucguuuaaaaauggacaaauuaagauuaaaagggguauccuacucccuaugcacagcugcuuuuacuuucacaaaaauuccugcagaaacacuucauggaaccguaacaguagaaguacaauacgcgggaacagaugggcccugcaaaguacccgcacaaauggcaguagauaugcaaacauuaacaccuguaggcagauugauaacugcuaauccaguaauaacagaaucaacagaaaauaguaaaaugaugcuagaauuagacccaccauuuggcgauaguuauauagucauuggaguuggggagaagaaaauaacucaucacuggcacagaucaggaaguacuauaggaaaagcauucgaagcaacagugagaggagcaaaaagaauggcaguauuaggugauacagcuugggauuuuggaucaguaggaggagcacuaaacucucuagguaaaggaauccaucaaauuuuuggugcagccuuuaaaucauuauuuggaggaaugucaugguucagucaaauauuaauagguacauuauuaauguggcugggacuaaauacuaaaaacgguaguauaagccuaaugugucuagcacucggugguguacuaauauucuuaaguacagcagucucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10910 - RNA, 2038 nt, Artificial Sequence
  ZIKV (isolate Z1106033) ME variant mRNA Design 3 opt
gggagaaagcuuaccauggcgauaaguggaguaccaguguuaggauuuuuuauaauagcaguacuaaugucugcucaagaaucaugggcagcagucacauuaccaucacacucaacuaggaaauuacagacccgaucgcaaaccuggcuggaaucaagagaauauacaaaacacuuaauaagaguagaaaauuggauauuuagaaaucccggauucgcacuagcagcggcugcaauugcuugguuacuuggauccaguacaucccaaaaaguaauauauuuaguaaugauacuucuuaucgcaccagccuauaguauuagauguauuggaguaucaaauagagauuuuguagaaggaaugucaggagguacuuggguugaugugguacuagaacacggcggaugugucacaguaauggcacaagauaaacccacaguagauauagaauuaguaacgacaacagugucaaauauggcagaaguaagaucauauugcuacgaagcaaguauaagugacauggcaucagauucacgauguccaacacaaggagaagcauauuuagauaaacaaucagacacacaauauguauguaaaagaacauuagucgauagggguuggggaaacggaugcggcuuauuuggaaaaggauccuuaguaaccugugcaaaauucgcauguucgaaaaagaugacaggaaaaucuauacaaccagaaaauuuagaauauagaauaaugcuaucaguacacggaucucaacauucagguaugauaguaaaugauacuggacaugaaacagacgagaacagagcaaaaguagaaauaacuccaaauagcccacgugcggaggccacacuaggaggauuuggaagccuggggcuagacugugaaccuagaacaggacuagauuucucagaccuauauuauuuaacaaugaauaacaaacauugguuaguccacaaagaaugguuucaugauaucccacuaccauggcacgcaggugcagauacggguacaccacauuggaauaacaaagaagcauuagucgaauuuaaagaugcccaugcaaaaagacaaacaguaguaguacuagguucacaagaaggagcugugcauacagcacuagcuggugcauuagaagcagaaauggauggagcaaaaggaagauuaucaagcggacauuugaaaugucgacuaaaaauggauaaacuuaggcuuaaagguguaagcuacucuuuauguaccgcagcauucacguucacaaaaauaccagccgaaacauuacacgguacuguaacaguagaaguacaauacgcagguacagauggaccauguaaaguaccagcucaaauggcaguagacaugcaaacuuuaacaccaguagggagauuaauaacagcgaauccaguaauuacagaauccacagaaaacaguaaaaugaugcuagaauuagauccacccuuuggagacucauauaucguaauagguguaggugaaaaaaaaauaacacaucacuggcaucgaucuggaucaaccauaggaaaagcauuugaagcuacaguaagaggagcgaaaaggauggcaguuuuaggagacacugcaugggauuuugguaguguaggaggagcauuaaauucauuggguaaaggcauacaucaaauauucggagcagcauuuaaaagcuuauuuggaggaaugaguugguuuucacaaauacuaauaggaacuuuacuuaugugguuaggucuaaaugcuaaaaauggcucaauaucacuaauguguuuagcacuagguggaguacuaauauuuuuaaguacagcuguaucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10911 - RNA, 2026 nt, Artificial Sequence
  ZIKV (strain MR 766) ME variant mRNA Design 3 opt
gggagaaagcuuaccauggcaauaucagguguaccagucuuagguuucuuuauaauagcaguauuaaugucagcacaagaaagcugggccgcaguaacucuacccagucacucgacaaggaaacuacaaaccagaucacaaacaugguuagaaaguagagaauauacaaaacaccuuauuaaaguagaaaauuggauauuuagaaauccuggguucgcguuagucgcaguagcaauagcauggcuauuaggaagcagcacaagucaaaaaguaauauaccuaguaaugauauuacuaaucgcgccagcauauaguauacguuguauaggaguuucaaacagagacuuuguagaaggaaugucaggagguacauggguagaugucguauuagaacauggaggaugugucacaguuauggcucaagauaaaccaacaguagauaucgaauuaguaacaacuacugucaguaauauggccgagguuagaucauacuguuacgaagcaucaauaucagauauggcaagugauaguagaugcccaacacaaggagaagcauauuuagacaaacaaucagauacucaauacguauguaaacgaacacuaguagacagagguuggggaaacggauguggauuauuuggaaaaggaaguuuaguaacaugugcaaaauuuacuugcucaaaaaaaaugacuggaaaaucaauucaaccggaaaaucuagaauaucgaauaaugcuaaguguacauggaagccaacauucaggaaugauuggcuaugaaacugaugaagacagagcuaaaguugaagugacaccaaacucaccuagagcagaagcaacauuaggagguuucgguucauuaggauuagauugcgaaccacgaacagguuuagauuucagugaucuauauuauuuaacaaugaacaauaaacauuggcuaguacauaaagaaugguuccaugauauaccacucccauggcaugcgggugcagacacaggcacuccacacuggaacaauaaagaagcuuuaguagaauuuaaagaugcacacgcaaaaagacagacaguaguuguacuaggaucacaagaaggagcaguacacaccgcacuugcaggcgcauuagaagcggaaauggacggagccaaagguagauuauuuaguggacauuuaaaauguagauuaaaaauggauaaauuaagacuaaaaggaguaagcuacucauuaugcacagcagccuuuacauuuacaaaaguacccgcugaaacauugcacggaacaguuacaguugaaguucaauacgcaggaacagauggaccauguaaaauaccaguacaaauggcagucgacaugcaaacauuaacaccaguaggucgacuaauaacagcaaaccccguuauaaccgaaucuacugaaaacucgaaaaugaugcuagaacuagacccaccguuuggagauucauauauaguaauaggcguaggagauaaaaaaauaacacaucauuggcacagauccggaagcacaauaggaaaagcauuugaagcuacaguaagaggagcuaaaagaauggcaguauuaggagauacagcaugggacuuuggaaguguaggagguguauuuaacaguuuaggaaaaggaauacaucaaauauuuggcgcagccuuuaaaagccuauucggaggaaugagcugguuuucacaaauucuaaucggaacucuacuaguguggcuaggacuuaauacaaaaaaugguagcauaaguuuaacaugucuagcauuaggagguguuaugauauuucuaucaacagcgguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10912 - RNA, 2038 nt, Artificial Sequence
  ZIKV (strain NatalRGN) ME variant mRNA Design 3 opt
gggagaaagcuuaccauggcaauuucuggaguuccaguauuagguuuuuuuauuauagcgguacuaaugagugcacaagaaagcugggcagcaguaacauuaccuagucauaguacuagaaaacuacaaacaagaucacaaacaugguuagaaucgcgagaauauaccaaacauuuaauaagaguagagaacuggauuuucagaaauccaggcuucgcccuagcagcagcagcaauagcaugguuauuaggaaguucaacaucacaaaaaguuauauaucuagucaugauauuauugauagcgcccgcauauucaauacgauguaucggaguaucaaauagagauuuuguagaaggaaugucuggaggaacuuggguagacgucguacuagaacacgggggauguguaacaguaauggcucaagauaaaccuacaguagauauagaauuaguaacgacaacaguaagcaacauggcagaagucagauccuauuguuaugaagccaguauuagcgacauggcgagcgauagcagauguccaacacaaggggaagcuuauuuagauaaacaaucagacacacaauacguauguaaaagaacauuaguagauagagguuggggaaaugguuguggacuuuuuggaaaaggaaguuuaguaacaugugcaaaauuugcaugcucuaaaaaaaugacaggcaaaucaauacaaccagagaaccucgaauauagaauaauguuaagcguacauggaagucaacauagcgguaugauaguaaaugacaccggacacgaaacagacgaaaauagagcaaaaguagaaauaacgccaaauaguccgcgcgcagaagcaacauuaggaggauucggaucacuaggauuagacugugaaccaagaacaggacuugauuuuucugaucuauacuaucuuacaaugaauaauaaacauugguuaguucauaaagaaugguuccaugauauuccuuuaccauggcacgcaggugcagauacaggaacaccacauuggaauaauaaagaagcauuaguagaauucaaagaugcucaugcuaaacgucaaacuguaguuguauuaggaagccaagaaggagcaguucauacugcauuagcaggagcauuagaagcugaaauggauggugcaaaagguagauugaguaguggacauuuaaaauguagacuaaaaauggacaaauuacgacuaaaaggaguuucauauagucuauguacugcugcauuuacauucacaaaaauaccagcugaaacauuacacggaaccguuacaguugaaguacaauacgcaggcacagauggaccaugcaaaguuccagcacaaauggcaguagacaugcaaacauuaacaccaguaggaagacuaauuacagcaaauccuguaauaacagaaucaacugaaaauagcaaaaugauguuagaauuagauccaccauuuggagauucauauauugugauaggaguaggagaaaaaaaaauuacacaccacuggcauagaucugggucaacaauagguaaagcauucgaagcuacuguaagaggagcaaaaagaauggcaguacuuggagauaccgccugggauuucgguaguguaggaggagcacuaaacucacuuggaaaaggcauacaucaaauauuuggagcagcauuuaaaucacuauuugguggaaugucaugguuuucacagaucuuaauagguacacuacuaauguggcuaggacuuaauacaaaaaauggaucaauaucauuaauguguuuagcauuaggaggaguuuuaauuuuuuuaagcacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10913 - RNA, 2017 nt, Artificial Sequence
  ZIKV (strain ZikaSPH2015) ME variant mRNA Design 3 opt
gggagaaagcuuaccauggauuggacauggauauuauucuuaguugcagcugcaacaagaguacauagugcaguaacauugccgucacacucaacaaggaaauuacaaacaagaagccaaacaugguuagaaagccgagaauacacaaaacauuuaauuagaguagaaaacuggauauuuagaaauccaggauuugcucuagcggcagcagcaauagcaugguuacuuggaucaucaacaagccagaaaguaauauacuuaguaaugauacuucuuauagcuccagcauacucaauacgauguauuggaguaagcaauagagauuuugucgaaggaaugucaggaggaacaugggucgacaucguauuagaacaugguggauguguuacaguaauggcacaagauaaaccuacuguagauauagaacucguaacuacaacuguaucaaacauggcagaaguaagaucauacugcuaugaagcaucaauaagugauauggcaucggauaguagauguccuacacaaggagaagcauauuuagauaaacaaucagauacacaauacguauguaaacguacuuuaguagauagagguuggggaaauggaugcggauuauuuggaaaagguaguuuaguaacaugugcaaaauuugcuuguucaaagaaaaugacagguaaaaguauacaaccagaaaauuuggaauauagaauaauguuaucuguacauggaagccaacauaguggaaugauuguaaaugauacaggacaugagaccgaugaaaauagagcaaaaguagaaauaacuccaaauucaccacgagcagaagcgacauuaggaggauucgguucauuagguuuagauugugaaccaagaacagggcuagauuuuucugaucuauauuaucuaacuaugaacaauaaacauuggcuaguacauaaagagugguuucaugacauaccauuaccauggcaugcuggagcagauacaggaacaccacauuggaacaauaaagaggcuuugguugaauuuaaagacgcccacgcaaaaagacagacaguagucguuuuaggcagucaagaaggagcaguucacacagcauuagcuggagcauuagaagccgaaauggacggagcaaaaggucgauuaucaaguggacaccuaaaauguagauuaaaaauggacaaacuacgacuuaaagggguuucauauucacuauguacagcagccuuuaccuuuacaaaaauaccagcagaaacuuuacaugguacaguaacagucgaaguccaauaugcagguacagauggcccauguaaagucccggcacaaauggcaguagauaugcagacacuaaccccaguaggaagacuuauaacagcaaauccaguuauaacagaaucuacugaaaauucaaaaaugauguuagaguuagauccuccauuuggagauagcuauaucguaauaggagucggagaaaagaaaauaacacaucauuggcauagaaguggaaguaccauaggaaaagcauuugaagcaacaguaagaggagccaaaagaauggcaguacuuggagauacggcaugggauuuuggcagcguaggaggugcauugaauaguuuaggaaaaggaauacaucaaaucuuuggugccgcauucaaauccuuauuuggaggaaugagcugguuuucacaaauacuaaucggaacauuacuaaugugguuaggauuaaauacuaaaaauggaagcauaaguuuaaugugccuggcacuaggaggaguacuaauauuuuuaaguacagcagugagcgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10914 - RNA, 2017 nt, Artificial Sequence
  ZIKV (isolate Z1106033) ME variant mRNA Design 3 opt
gggagaaagcuuaccauggauuggacauggauauuauucuuaguagcugcagcaacccgaguacacucagcagucacauuacccagucauagcacaaggaaauuacaaaccagaucacaaacuugguuagaaucaagagaauacacaaaacaucucauaagaguugaaaacuggauauuuagaaaccccggcuuugcucuagcagcagcagcaauugcauggcuacuaggaagcucuacaucacaaaagguaauauauuuaguaaugauacuauuaauagcaccagcuuacaguauuagauguauaggaguuucgaauagagacuuuguagaaggaaugucaggagguacauggguagauguaguacuagaacauggcggaugugugacaguuauggcacaagauaaaccaaccguagauauagaauuagugacgacaacaguaucaaauauggccgaaguaagaucuuauuguuaugaagcauccauuucugacauggccucagauaguagaugccccacucaaggagaagcauacuuagauaaacagucagacacucaauacguuuguaaaagaacucuaguagauagagguugggguaauggauguggauuauuuggaaaaggaagccuaguaacaugcgcaaaauuugcauguaguaaaaagaugacuggaaaaucaauacaaccagaaaaccuugaauaucgaauuauguugucaguccacggaagucaacauaguggaaugauaguaaaugacacaggacacgaaacagacgaaaauagagcuaaaguagaaauaacaccaaauucuccgagagcugaagcaacacuuggaggauuugguagcuuagguuuagacugugaaccaaggacuggauuggacuuuucagaucuauauuauuuaacaaugaauaauaaacacuggcuaguacacaaagaaugguuucacgauauuccauuaccauggcaugcaggagcugacacagguacaccacauuggaauaauaaagaagcauuaguagaguucaaagaugcacacgcgaaaagacaaacaguaguagugcuagguucacaagaaggagcaguacauaccgcauuagcaggagcauuagaagcagaaauggauggagcaaaagggagacuaucaaguggacauuuaaaauguagauugaagauggauaaauuaagauugaaagggguaucuuacaguuuauguacugcagcuuucacauuuacaaaaauaccagcagaaacacuacauggaacaguaacaguugaaguacaauacgcaggaacagauggacccugcaaaguuccagcucaaauggcaguagauaugcaaacucuaacgccaguaggacgguuaauaacagccaauccagugauuacagaaucgacagaaaacucaaaaaugaugcucgaauuagauccacccuuuggagauucauauauuguuauaggaguaggagaaaagaaaauaacacaucauuggcauaggagcggcucaacuauaggaaaagcauucgaagcaacaguaagaggagcuaaacgaauggcaguauuaggagauacagcuugggacuucggaagcguuggaggagcccuaaauaguuuaggaaaaggaauacaucaaauauucggagcagcauuuaaaucauuauuuggaggaaugaguugguucucacaaauucuuauuggaacccuauuaauguggcuaggcuugaaugcuaaaaauggaaguauaagucucaugugcuuagcacuaggagggguauuaauauuuuuauccaccgcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10915 - RNA, 2005 nt, Artificial Sequence
  ZIKV (strain MR 766) ME variant mRNA Design 3 opt
gggagaaagcuuaccauggauuggacauggauauuauuuuuagucgcagcagcaacuagaguacauucugcaguuacuuuaccaagucauucaacaaggaaacuacaaacaagaucacaaacauggcuagaaucaagagaauacacuaaacaucuaauaaaaguagaaaauuggauauuuagaaaucccggcuuugcacucguggcaguagcaauagcaugguuguuagggagcucuaccagucaaaaaguuauuuaucuuguaaugauacuacuaauagcaccagcauauagcauaagauguauaggaguuagcaacagagacuuuguggaaggaaugucaggaggaacauggguagaugucguacuagaacauggcggauguguaacaguaauggcacaagauaaaccaacaguagauauagaacuaguaacaacaacuguaucuaauauggcagaaguaagaucauacuguuaugaagcaagcauuucugauauggcaucagauagcagaugcccaacacaaggagaagcauaucuagauaaacaaagugauacacaauacguaugcaaaagaacauuaguugacagaggaugggggaaugguugcggucuguuuggaaaaggaaguuuaguuacaugugcuaaauuuacaugcaguaaaaaaaugacuggaaaaagcauucaaccagaaaauuuagaauaccgaauaauguuaagcguacauggaagccaacacucaggaaugauaggauaugaaacagaugaagauagagcuaaaguagaagucacaccgaauucaccaagagcugaagcaacucuaggagguuuugguucacuugguuuagauugugaaccaagaacaggacuagacuucucagauuuguauuaccuaacaaugaauaauaaacauuggcuaguucauaaagaaugguuucacgacauaccauugccuuggcacgcaggagccgauacuggaacaccacauuggaauaauaaagaagcacucguagaauuuaaagaugcacaugccaaaagacaaacuguagucguacuaggaagucaagaaggggccguacauacugcauuagcaggcgcacuagaagcugaaauggauggcgcaaaagguagacuauucagcggacaccuaaaaugucgauuaaaaauggauaaauuaagauuaaagggaguaagcuauucuuuauguacagccgcuuuuacauucacuaaaguaccagcagaaacauuacacgguacaguaaccguagaaguccaauacgcaggaacagauggaccaugcaaaauuccaguacaaauggcaguagauaugcaaacguuaacaccaguaggucgauuaauuacagcaaauccaguaaucacagaaucaacagaaaauucgaaaaugaugcucgaacuagacccuccauucggagauaguuauauaguaaucggaguaggagauaaaaaaauaacacaccacuggcauagaaguggcucaacaauagggaaagcauuugaagcaacaguaagaggagcaaaaagaauggcaguuuuaggugacacugcaugggacuuugguaguguaggagguguauuuaauagcuuaggaaaaggaauccaucaaauauuuggagcagcauucaaaucauuauucggugguaugucaugguucucacaaauucuaauagguacacuucuuguuugguuaggucuaaauacaaaaaauggaucaauuucucuaacauguuuagcuuuaggaggggucaugaucuucuuaucuacggcaguaucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10916 - RNA, 2017 nt, Artificial Sequence
  ZIKV (strain NatalRGN) ME variant mRNA Design 3 opt
gggagaaagcuuaccauggacuggacauggauucuauuucucguagcagcagcaacaagaguucauucagcaguaacauuaccaucacauucaacaagaaaacuacaaacaagaagucaaacauggcuagaaucgagagaauauacaaagcauuuaaucagaguagaaaacuggauauuuagaaacccuggauuugcauuggccgcugcugcaauagcaugguuacuuggaagcagcacaagucaaaaaguaauauaucuaguaaugauacuauuaauagccccagcauauucaauuagauguauaggagucucaaauagggauuucguagaaggaaugaguggaggaacauggguagacguaguacuagaacacggugggugcguaacaguaauggcacaagacaaacccacaguagauauagaauuagugacaacuacaguuaguaacauggcagaaguuagaaguuauuguuacgaagcaagcauaagugauauggcaagcgauucucgauguccgacucagggagaagcauaucuagacaaacaaucugauacacaauauguguguaaacgaacucuagucgauagaggguggggaaauggauguggacucuuuggaaaaggaagucuaguaacgugcgcuaaauuugccuguaguaagaaaaugacgggaaaauccauacaacccgaaaacuuagaauauagaauaauguuaagugugcauggaagucaacauaguggaaugauaguaaacgauacaggacacgaaacagaugaaaauagagcaaaaguagaaauaacacccaauagccccagagcagaagcaacacuaggagguuuuggaucauuaggacucgauugugaaccuagaacuggguuagauuuuucagauuuauauuauuuaacaaugaauaauaaacauugguuaguucauaaagaaugguuucaugauauaccuuuaccauggcaugcuggggcagacacaggaacaccacauuggaauaacaaagaagcauuaguagaauuuaaagacgcacaugcuaaaagacaaacugugguagugcuagggagucaagaaggggcaguacauacagcauuagccggagcuuuagaagcagaaauggauggagcaaaaggaagauuauccagcggacaucuaaaauguagauuaaaaauggauaaauuacguuuaaaaggugugagcuacucacuuuguacagcugcauuuacauucacaaaaauuccagcagaaacccuacacggaacagucacagucgaaguacaauacgcaggaacagacggaccuugcaaaguacccgcucaaauggcagucgauaugcaaacauuaacaccuguagguagacuaauuacagcaaauccaguaauaacagaaucaacagaaaauaguaaaaugaugcucgaauuagauccaccauuuggugauucauauauaguuauaggaguaggagagaaaaagauuacacaucauuggcauagaaguggaaguacaauaggaaaagcauuugaagcaacaguaagaggagcaaaacgaauggcaguauuaggagauacagcuugggacuuuggaaguguuggaggugcacuaaauaguuuaggaaaaggaauacaucaaauauuuggagcagcauuuaaaucauuauuuggugguaugucgugguuuucccaaaucuuaauaggaacuuuauuaauguggcuaggauuaaauacgaaaaauggaucaauaucacucaugugucuagcauuaggaggaguuuuaaucuuuuuaucaaccgcaguuucagcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10917 - RNA, 2035 nt, Artificial Sequence
  ZIKV (strain ZikaSPH2015) ME variant mRNA Design 3 opt
gggagaaagcuuaccaugggaaaaagguccgcaggaaguauaaugugguuagcuagcuuagcaguagugauagcaugugcaggagcugcaguaacauuaccaucacauuccacaagaaaacuacaaacaagaucucaaacaugguuagaaucaagagaauacacaaaacaccuaauacgaguagaaaacuggauauuuagaaauccuggauucgcacuagccgcagcagcaauugccugguuauuaggaaguaguacaagccaaaaaguaauauauuuaguaaugauauuauuaauugcaccagcauauaguauaagauguauaggaguaaguaauagagauuuuguagaaggaaugaguggagguacauggguagauauaguauuagaacacggaggauguguaacaguuauggcucaagauaaaccuacaguugauauugaauuaguaaccacuacaguaucaaauauggcugaaguaagaaguuauuguuaugaagcaaguauuagcgauauggcgagugauagcagaugucccacacaaggugaagcauacuuagauaaacaaagugacacacaauauguaugcaaaagaacucuaguagauagaggauggggaaacgguugcggauuauuuggcaaagguagcuuagucacaugugcaaaauuugccugcaguaagaaaaugacaggaaaaaguauacaaccagaaaauuuagaauauagaauaaugcuuagcgugcacggaucacaacauucaggaaugauagugaaugauacaggacaugaaacagacgaaaauagggcaaaaguugaaauuacgccaaauagucccagggcagaagcaaccuugggaggauuuggcaguuuaggacuagauugugaaccaagaaccggauuagauuucucugaucuauauuauuuaacgaugaauaauaaacacugguuaguacacaaagaaugguuucaugauauaccauuaccguggcacgcaggagcagauacaggaacaccucauuggaauaauaaagaagcucuaguagaauuuaaagacgcccacgcgaaaagacaaacagucguaguauuagguagccaggaaggagccguucacacagcauuagccggugcuuuagaagcagaaauggauggagcaaaagguagacuaagcaguggacacuuaaaauguagguuaaaaauggacaaauuaagacuaaaagguguaucauauaguuuauguacagcggcauuuacguucacaaaaauucccgcagaaacauuacacggaacaguaacaguagaaguacaauaugcaggaaccgauggaccauguaaaguaccagcacaaauggcaguagauaugcaaacauuaacaccuguaggaagacuuaucacagcaaauccuguuauaacagaaagcacagaaaauucaaaaaugauguuagaauuagacccaccauucggugauaguuacauaguaauaggaguaggcgagaagaaaauuacacaucauuggcauagaucaggauccacaauagguaaagcguucgaagcaacagugagaggagcaaaaagaauggcaguauuaggggauacugccugggauuuuggaucaguagggggagcauuaaauagucuaggaaaagguauacaccaaauuuuuggagcggcuuuuaaaucucuauuuggugggaugucaugguuuucacaaauacuaauaggcacacuacucauguggcuaggauuaaacacgaaaaauggaagcauaucauuaaugugucuagcacuaggagguguccuaauauuccugucaacagcaguaagugcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10918 - RNA, 2035 nt, Artificial Sequence
  ZIKV (isolate Z1106033) ME variant mRNA Design 3 opt
gggagaaagcuuaccaugggaaaaaggagcgcaggaucaaucaugugguuagcaucauuagcaguaguaauugccugcgcuggugcagcaguaacauugccaagucauucuacaagaaaacuacagacaagaagccaaacauggcuagaaucuagagaauacacaaaacauuuaauaagaguugaaaacuggauauuuagaaauccaggauuugcacuagcagcagcagcaauagccugguuauuaggaaguucaacaagucaaaaaguaauuuacuuaguaaugauacuauuaauagcuccagcauauaguauaagauguauaggaguaucaaauagagauuuuguugaagguaugaguggaggaacauggguagauguuguacuagaacauggaggauguguaacuguaauggcacaagauaaaccaacagucgacauugaacuaguaacaacuacagugucuaacauggcugaaguaagaucauauugcuaugaagcaucuauaagugauauggcaucagauagcagauguccuacucaaggagaagcauaucuugauaaacaaucagauacacaauauguauguaaaagaacauuaguagauagaggauggggaaaugguuguggcuuauuuggaaaaggaagucuaguaacaugugcaaaauuugcaugcaguaaaaaaaugacgggaaaaaguauacagccagaaaaccuagaauacagaauuauguuaagcguucaugguagucaacauaguggaaugauaguaaacgauacugggcaugaaacugacgagaauagagccaaaguagaaauaacaccaaauucaccgagagcagaagcuacacuugguggauucggaucacuuggucuagauugcgaaccaagaacaggacuugacuucucagaccuauauuaucuaacaaugaauaauaaacauugguuaguucauaaagaaugguuucaugauauaccauuaccauggcaugcaggagcagauacgggaacaccacauuggaauaauaaagaagcacuagucgaauuuaaagaugcacaugcaaaaagacaaacgguaguuguacuaggaucacaagaaggagcaguacauacagcauuagcuggggcuuuggaagcagaaauggauggcgcgaaaggaagacuaucaaguggacauuuaaaaugccgauugaaaauggauaaauuaagauuaaaaggaguaaguuacucauuauguaccgcugcguuuacauuuacgaaaauuccagcagaaacguuacauggaacaguaacagucgaaguucaauaugcaggaacagacggaccauguaaagugccagcacaaauggcaguagacaugcaaacauuaacaccagugggaagauuaauaacagcaaacccaguaauaacagaaucuacggaaaauagcaaaaugauguuagaacuagacccacccuucggagauucauauauuguaauaggaguuggagaaaaaaaaauuacgcaucacuggcauagaagugguaguacaauuggaaaagcauuugaagcuacaguaaggggagcaaaaagaauggcaguacuaggagauacugcaugggauuucgguaguguuggaggugcacuaaauagccuuggaaaaggaauucaucagauauuuggagcagcauuuaaaucauuauuuggaggcaugaguugguucagucaaauauuaauuggaacucuauuaaugugguuagguuuaaacgcaaagaauggaucaauaaguuuaauguguuuagcacuaggaggaguauuaauauuccuuucaacagccguuucggcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10919 - RNA, 2023 nt, Artificial Sequence
  ZIKV (strain MR 766) ME variant mRNA Design 3 opt
gggagaaagcuuaccaugggaaaaagaucagcaggaaguauaaugugguuagcaucacuagcaguaguaauagcaugugcuggagcagcaguaacauuaccaucacauucaacaagaaaauuacagacaagaagccaaaccugguuagaaucaagagaauacacaaaacauuuaauaaaagucgaaaacuggauauuuagaaauccaggauucgcucuaguagcaguagcaauagcuugguuacuaggaucaagcacaucacaaaaagugaucuaucuaguuaugauacuauuaauagccccugcauauucuauaaggugcauaggaguaagcaacagagauuuugucgaaggaaugucaggaggaacauggguagauguugucuuagaacauggagguugcguuacaguaauggcacaagauaaaccaaccguggauauugagcuaguaacgacaacaguaaguaacauggcagaaguaagaaguuauuguuacgaagcaaguauaucagacauggcaucagauucaagauguccgacucaaggagaagcauaucuagauaagcaaucagauacacaauacguuugcaaaagaacauuaguagauagaggauggggaaauggaugcggauuauuuggaaaaggaaguuuaguaacaugcgcaaaauuuacuuguaguaagaaaaugacaggaaaaaguauucaaccugaaaaucucgaauauagaaucaugcuaaguguucauggaagccaacauucuggcaugauaggauaugaaacagaugaagauagggcaaaaguagaaguuacaccuaauucaccaagagcagaagcaacauuaggagguuuuggaaguuugggacuagacugugaaccucgaacugguuuagacuuuagugauuuauacuauuuaacgaugaauaauaaacauuggcuuguacauaaagaaugguuucaugacauaccauuaccauggcacgcaggagcagauacaggaacaccacacuggaauaauaaagaagcauuaguagaguuuaaagaugcucaugcaaaacgacaaacagugguaguauuaggaucucaagaaggagcuguacauacagcucuggcgggugcauuggaagcagaaauggauggagcaaaaggacgacuguucagcggacauuuaaaaugcaggcuuaaaauggauaaauuaagauuaaaaggaguaucauauucacuauguacagcugcuuuuacauucacaaaagucccagcagagacucuacauggaacaguaacuguugaaguacaauaugccggaacagauggaccauguaaaauuccuguacaaauggcaguagauaugcaaacacuuacuccaguaggaagauuaauaacggcaaaccccguuauaaccgaaucaacagaaaauaguaaaaugaugcuagaacuagauccuccauuuggugauucauauauaguaauaggaguaggagacaagaaaauaacacaccauuggcauagaaguggaaguacuauaggaaaagcauuugaagcaacagugagaggagccaaaagaauggcuguacuaggagauacagcaugggauuucgguucaguaggcggaguuuuuaacucauuaggaaaagggauacaucaaauauuuggagcagccuucaaaucacuguucggcggaaugagcugguuuucucaaauauugauugggacccuauugguauggcucggacuaaauacuaaaaaugguagcauaucauuaacaugccuagccuuaggaggaguaaugauuuuccuuagcacagcaguuagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10920 - RNA, 2035 nt, Artificial Sequence
  ZIKV (strain NatalRGN) ME variant mRNA Design 3 opt
gggagaaagcuuaccaugggcaaaagaucagcaggaagcaucaugugguuagcuaguuuagcagucguaauagccugugcaggagcagcaguaacauuaccgagccacucaacaaggaaauugcaaacccggagccaaacauggcuagaaaguagagaauauacaaaacaucuaaucagagucgaaaacuggauauucagaaauccuggauuugcauuagcagcagcagcaauagcauggcuauuaggaucaaguacaagucaaaaaguaauauaucuaguuaugauauuacuaauagcaccagccuacucaauaagauguauaggaguaagcaauagagacuuugucgaaggaaugagcggaggaacuuggguagauguaguauuagaacacggagguugcguaacggucauggcacaagacaaaccaacaguagacauugaauuaguaacaacgacaguuucaaauauggcagaaguccgaaguuacuguuaugaagcgucaauaucugacauggcaagugacucuagauguccuacucaaggagaggcuuauuuagauaaacaaagugauacacaauauguauguaaacgaacguuaguggauagaggaugggguaaugguugcggucuguucgguaaaggaucucuaguaacaugugcaaaauuugcuuguuccaagaaaaugacaggaaaaucaauacaaccagaaaauuuagaauaucgaauaauguuaaguguacauggaagucaacauaguggaaugauuguaaaugauacaggacaugaaacagaugaaaauagagcaaaaguggaaauaacuccaaauucaccaagagcagaagcuacauuaggaggcuuugguagcuuaggauuagacugcgaaccaaggacgggucuagacuuuagugaccuuuauuaucuaacaaugaauaauaaacauugguuaguacauaaagaaugguuccaugauauuccauuaccauggcacgcaggagcagauacuggaacaccacauuggaacaauaaagaagcauugguugaauuuaaagaugcacaugccaaaagacaaacaguaguaguacuuggaucccaagaaggagcaguacauacagcauuagccggugcauuagaagcagaaauggacggagcaaaagguagacuuagcagcggacaucuuaaauguagacuaaaaauggauaaauuaagauuaaaaggaguaucuuauagucuaugcacagcagcauucacuuuuacuaaaauacccgcagaaacguuacauggaacaguaacaguagaaguacaauaugcaggaacagauggcccauguaaaguaccagcacaaauggcaguugauaugcagacauuaacaccuguaggaagacuaauaacagcaaauccaguaauaacagaaucaacagaaaauaguaaaaugauguuggaauuagauccaccauucggagauucuuacauaguaauaggaguaggagaaaagaaaauaacccaucauuggcauagaucaggaaguacaauuggaaaagcauuugaagcaacaguaagaggagcaaaacgaauggcaguacuuggagacacagcaugggauuuugguucgguaggaggagcauuaaauucacuagguaaaggaauacaucaaauauuuggagcagcguuuaaaucacucuucgguggaaugucaugguucagucaaauucuaauaggaacauuauuaauguggcucggucuaaauacgaaaaauggaucaauuucacucauguguuuagccuuagguggaguccucauauucuuaucaacagcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10921 - RNA, 2311 nt, Artificial Sequence
  ZIKV (strain ZikaSPH2015) prME-short variant mRNA Design 3 opt
gggagaaagcuuaccauggccauaagcggcguacccguccucggauucuucauaaucgcaguccucaugagcgcccaagaaaguugggccgucacccgcagaggaagugcauacuacauguaccucgaccgcaacgacgcgggagaagccaucuccuucccaaccacccuaggcaugaacaaaugcuacauccaaaucauggaccuaggacauaugugcgacgccacaaugagcuacgaaugccccaugcucgacgaagguguagaacccgacgacguagacugcuggugcaacacaacaucaaccuggguaguauacggaacaugccaucacaaaaagggagaagccagacgcagccgcagagccguaacacuacccucacacucgacacgaaaacuucaaacacggucacagaccuggcuagaaucccgugaauacaccaaacaccuuauaagaguagagaacuggaucuuccgaaaccccggguucgcccucgccgccgccgccaucgcauggcuacucggcuccagcacaucacaaaaaguuauauaccuaguuaugauccuccugauagccccugccuauagcauaagauguauaggcguaucaaaccgcgacuucguagaaggcaugucaggcggaacauggguggacauaguccuagaacacggcggcugcgucaccguaauggcccaagacaaaccaaccguagacauagaacuuguaaccaccacggugucaaacauggccgaaguacggagcuacugcuacgaagccucaauuuccgacauggcgagcgacuccaggugcccgacacagggagaagcauaccucgacaagcaaucagacacccaguacgucugcaagagaacacucguagacagaggcuggggaaacgguugcggacuguucggcaaaggcagccuggucacaugcgcgaaauucgccuguagcaaaaagaugaccggaaagucgauccaacccgaaaaccuagaauacaggaucaugcugagcguccauggcagccaacacagcggcaugaucguaaacgacaccggacacgaaaccgacgaaaaccgggcuaaaguagaaaucaccccaaacucccccagagccgaagccacgcuagggggauucggcucacuugggcucgacugcgaacccagaaccggacuagauuucagcgaucuauacuacuuaaccaugaacaacaaacacuggcucguacacaaagagugguuccacgacauaccccugccauggcacgccggcgccgacaccggcacaccacacuggaacaacaaagaagcgcuuguagaguucaaggacgcacacgcuaaacgccaaaccguaguagugcuggggagccaagaaggcgcgguacacacggcccucgccggggcacuagaagcagaaauggacggagccaaggggcggcugucaagcggccaccugaaaugccgccucaaaauggacaaacuuaggcuuaaaggagucuccuauagccuaugcacggccgccuucaccuucacaaaaauaccagccgaaacccuccacggcacuguaacagucgagguccaauacgccggcacagacggacccuguaaaguaccagcgcagauggccguagacaugcaaacgcuuacacccguaggacgccuaaucacagcaaacccaguaaucaccgaguccacagaaaacagcaaaaugaugcuugaacucgaucccccauucggggacuccuacauagucaucggcgucggcgaaaagaaaauaacccaccacuggcaccgcuccggcucaacgauaggaaaggcauucgaagcaacaguaagaggagcaaaaagaauggcaguccucggggacacagccugggacuucggaucgguaggcggcgcccucaacagccucggaaagggcauacaccaaaucuucggagcagccuucaaaucacuauucggaggcaugagcugguucagucaaauccugaucggcacccuccucauguggcucggccucaacacgaaaaacggauccaucucccucaugugccuagcacucggcggaguccucauauuccuuuccaccgcggugagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10922 - RNA, 2311 nt, Artificial Sequence
  ZIKV (isolate Z1106033) prME-short variant mRNA Design 3 opt
gggagaaagcuuaccauggcaauaucgggaguacccguacugggauucuucauaauagcaguccucauguccgcacaagaauccugggcagucacaagacgcggauccgccuacuacauguaccuagaccgaaacgacgccggcgaagccaucucauucccaacaacacuaggaaugaacaaaugcuacauccaaaucauggaccucggacauacgugcgacgcaacaaugagcuacgaaugccccaugcuggacgaaggaguagaaccagacgacgucgacugcuggugcaacacaaccagcacuuggguaguauacggcacaugccaccacaagaaaggcgaagccagacgaagcagaagggcaguaacccuaccuucgcacucgacccgaaaacugcagacaagaagccagacauggcuggaaucacgcgaauacacaaaacaccucauacgagucgagaacuggaucuucaggaaccccggauuugcccuggcggccgccgcaaucgcauggcuccucggcagcucaacgucacaaaaaguaauauaccuggucaugauccuacucaucgcacccgccuacagcaucagaugcauaggagucagcaaccgggacuucguagaaggcaugagcggcggcaccuggguagaugugguucuagaacacggcgguugcgucacagugauggcacaagacaaacccaccguagauauagagcuagucaccaccaccgucagcaauauggccgaaguccggagcuacugcuacgaagccagcaucagcgacauggcauccgacagccgcugcccaacccaaggagaggcauaccuagacaaacaaagugacacacaauacgucugcaaacgaacacucguagacagaggcuggggcaacggauguggccucuucgguaaaggcucacucgucacaugcgcaaaauucgcaugcagcaagaaaaugaccggcaaaagcauccaaccagaaaaccuugaguauagaaucaugcuaucgguacacggaucccaacauucaggcaugaucguaaacgacacgggccaugaaacagacgaaaaucgagccaaaguagaaauaaccccgaacagcccgagggcagaggcaacacucgguggauuuggcagccugggccucgacugcgaaccccgaaccggucuugacuucuccgaccuguacuaccuaacaaugaacaacaaacacuggcucgugcauaaagagugguuccacgacaucccacugcccuggcacgccggcgcagacaccgguacgccacacuggaacaacaaagaagcacucgucgaguucaaagacgcacacgcaaaacgccaaacgguaguaguccucggcucacaagaaggagccgugcacaccgcccuagccggcgcacucgaagcagaaauggacggcgcaaaaggccgacucuccucaggccaccucaaaugccgccuaaaaauggacaaacugcgccucaaaggagucagcuacuccuuaugcacagcagccuucaccuucacaaaaauaccugcagaaacccuucacggcaccgucaccgucgaaguacaauacgcagguaccgacggccccugcaaaguaccagcccaaauggccguagacaugcaaacccugacccccgugggcagacuuauaaccgccaaccccguaauaacagaaagcaccgaaaacucaaaaaugaugcucgaacucgaucccccguucggcgacagcuauauagucaucggagucggcgaaaagaaaaucacacaucacuggcacagaucaggaagcaccaucggaaaagccuucgaggcgacaguacgcggagccaaacggauggccguccucggagacaccgccugggacuucggaucaguaggaggggcacuuaacucccuaggaaaaggcauccaccaaaucuucggcgcagccuucaaaucacuauucggggguauguccugguucucccaaauccuaaucggaacucuccucauguggcucggacucaacgcgaaaaacggcaguaucagccucaugugccucgcacuaggaggagugcuaauauuccuaucaacagcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10923 - RNA, 2299 nt, Artificial Sequence
  ZIKV (strain MR 766) prME-short variant mRNA Design 3 opt
gggagaaagcuuaccauggccaucucaggcgucccagugcucggauuuuucaucauagcaguauuaaugagcgcgcaagaaaguugggcaauaaccagacgcggcuccgccuacuacauguaccuggaccgcuccgacgcaggcaaagccaucagcuucgcaaccacccucggaguaaauaagugccacgugcaaauaauggaccuaggccacaugugcgacgccacaaugucauacgaaugcccgaugcucgacgaaggaguagaacccgacgacguggacugcuggugcaacacaacguccacauggguaguauacggaaccugccaccacaagaaaggagaggcaaggcgaagccgcagagcaguaacccuacccagccacaguacacgaaaacuacaaacgcggagccaaacuuggcuggaaucacgcgaauacacaaaacaccuaauaaaaguggaaaacuggauauuccggaaccccggauucgcacugguggcaguagcgauagccuggcugcucggcagcucaaccucccaaaaagucaucuaccucguaaugauacuccugauagcaccagcguacuccauaaggugcauaggcgucagcaaccgugauuucgucgagggaaugucaggaggaaccuggguagacguaguccuagaacacgggggcugcgugaccgucauggcccaggacaagccuacagucgacauagaacucgucacaaccacgguaagcaauauggcagaaguaagaagcuacuguuacgaagcaucaaucagcgacauggccagcgacucaagaugcccaacccaaggagaagccuaccuagacaaacagagcgacacccaauacgucugcaagcggacgcucguagacagaggcuggggaaauggaugcggccucuucggaaagggaagccuagugaccugcgccaaauucacaugcagcaagaaaaugacaggaaaauccauccaacccgagaaccucgaauaccgcauaauguuaagcguccacgggucacaacauagcgguaugaucggcuacgaaaccgacgaagacagggcaaaaguagaaguaacccccaacagcccaagagcugaagccacacucggaggauucggcagccuaggacuagacugcgaaccacgcacuggacuugacuucuccgaccuauacuaccucacgaugaacaacaagcacuggcuaguccacaaagaaugguuccacgacauaccccuaccuuggcacgccggcgcggacaccggaacaccacacuggaacaacaaagaggcacucgucgaguucaaggaugcacaugccaaacgccaaacagucguaguacugggaagccaggaaggagccguacacacagcccucgcaggagcacucgaagcugaaauggacggcgcaaaaggccggcuuuucagcggccaccucaaaugccggcuaaaaauggacaaacuccggcugaaagggguaagcuacagccucugcaccgcagcguuuacguucaccaaaguacccgcagaaacacuacacggcacaguaacagucgaggugcaauacgcaggcaccgacggccccugcaagauaccaguacaaauggcagucgacaugcaaacacugacaccugucgggcgacuaauaaccgcaaacccagucaucaccgaaagcaccgagaacagcaaaaugaugcucgagcuagacccaccauucggcgacagcuacaucgucauaggcgugggcgacaagaaaaucacacaccacuggcacagguccggcagcaccaucggcaaagccuucgaagcgacaguacgcggagcaaaacgaauggcagucuugggcgacacagccugggacuucggcagcgucggcggagucuucaacucacuagggaaaggaauacaccagauauucggagccgccuucaagagccuauucggaggaaugagcugguuuagccagauacucauaggcacccuacucgucuggcuaggucuaaacacaaagaacggcuccaucucauuaacaugccuggcauugggcggagugaugauauuucucagcacagccguaagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10924 - RNA, 2311 nt, Artificial Sequence
  ZIKV (strain NatalRGN) prME-short variant mRNA Design 3 opt
gggagaaagcuuaccauggccauauccggcguaccaguccucggguucuucauuauagcaguccucaugagcgcacaagaaucgugggccguaaccagacgaggaucugcauauuacauguaccuagaccggaacgacgcgggagaagccaucucauuucccacaacacucggaaugaauaaaugcuacauccaaaucauggaccucggccacaugugcgacgcaacgaugagcuacgaaugccccaugcuagacgagggggucgaacccgacgacgucgacugcuggugcaacacaacaucaaccuggguaguauacggcacaugccaccacaaaaagggcgaagcccgacgauccaggcgagcaguaacauuacccucccauuccacccgcaaacuccaaacgcgcucgcaaaccuggcuagaaucacgagaauacacaaaacaccucauccgaguagaaaacuggaucuucagaaauccgggauucgcccuggccgcugccgccaucgccuggcuacucggcuccagcaccucacagaaagucaucuaccucguuaugauacuccucauagcgccagccuacucuauccgcugcaucggaguaagcaaccgagauuucguagaaggcaugucaggcggcacaugggucgacgucguccuagaacacggaggcugcguaacagucauggcccaagacaaaccgaccgucgacaucgagcuaguaaccacaaccgucuccaauauggccgaaguccgaagcuacugcuacgaagcgucaaucuccgacauggcaagcgacucccgaugcccaacccaaggcgaagccuaccuagacaaacaguccgacacccaauacguuugcaaacgcacacucgucgaccgaggauggggcaacggcugcggccucuucgggaaaggaagccucguaaccugcgcaaaauucgcaugcagcaagaaaaugaccggaaaauccauccaacccgaaaaccuggaauaccgcauaaugcucucaguacacggaucccagcacagcggaaugauagugaacgauacaggacacgaaacugacgaaaaccgagcaaaaguagaaaucacccccaacucaccacgagcagaagccacccuaggcggauucggcucauuaggccucgacugcgaaccuaggacgggccucgacuucuccgaccuauacuaccugacaaugaacaacaaacacuggcuaguacacaaagaaugguuucacgauaucccccuacccuggcacgccggcgccgacacaggcacaccgcacuggaacaacaaggaagccuuaguagaguucaaagacgcccacgccaagcgccaaaccgucgugguccugggaucccaagaaggcgccguacacaccgcccuagcaggcgcccuugaggccgaaauggacggggcaaaaggccgccuaucauccggacaucucaagugccggcucaaaauggacaaacuacgacuaaaaggcguaagcuacucccucugcacagccgcuuucacauucaccaaaauaccagcggaaacucuccacggcaccgucaccgucgaagugcaauacgccggaacagacggaccaugcaaagugcccgcccaaauggccgucgacaugcagacucuaaccccaguagggcgacucauaaccgcaaaucccgucaucaccgaaagcaccgagaacagcaaaaugaugcucgaacuggacccucccuucggcgacagcuacaucgucaucggaguaggcgaaaagaaaaucacccaccacuggcaccgaucgggaagcaccaucggcaaagccuucgaagcgacagucagaggcgcaaaacgcauggccguccucggagacaccgcaugggacuucggcagcgucggaggcgcacucaacucucugggcaaagggauccaccaaauauucggcgccgccuucaaaucccucuucgggggaaugucgugguucucacagauacuuauaggaacacuacucauguggcucggacuaaacaccaaaaacggcuccauaucccucaugugccuagcccuaggaggaguccuaaucuuccucucgacagcggucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10925 - RNA, 2290 nt, Artificial Sequence
  ZIKV (strain ZikaSPH2015) prME-short variant mRNA Design 3 opt
gggagaaagcuuaccauggacuggacauggauacucuuccuaguagccgccgccacccgcguacacucagugacgcgccgcggcucagcauacuacauguaccucgaccggaacgacgccggagaggcgauaucauuccccaccacacuaggaaugaacaaaugcuacauacagaucauggaccucggccacaugugcgacgccacaauguccuacgagugcccaaugcuggacgaagggguagaaccagacgacgucgacugcuggugcaacaccacguccacauggguggucuacggcacaugccaccacaagaaaggagaagcgcgccgaucacgcagagccgucacccucccaagccacuccacaagaaaacuccaaaccagaagccaaacuuggcucgaaucccgggaauacaccaagcaccucauacgcguagagaacuggauauuccgcaacccaggcuucgcgcuagcagccgccgccauagccuggcuacuaggcucauccacaucacaaaaagugaucuaucuaguaaugauacuacuaauagcacccgccuacagcaucagaugcauaggcgucucaaacagagacuucguagaaggcaugucaggaggaaccuggguagauaucguacucgaacacggcggauguguaaccgucauggcccaagacaaacccacuguagauaucgagcuaguaacaacaacaguauccaacauggccgaaguaagauccuacugcuacgaagcaucaaucucagacauggccucagacucgaggugcccuacucagggagaagccuaccuagacaaacaaagcgacacgcaauacgucugcaaaagaacccuagucgauagaggcuggggaaacgggugcgggcuauucggcaagggaucacucguaaccugcgcaaaguucgcaugcuccaagaaaaugaccgguaaaagcauccaacccgaaaaccucgaauacagaaucaugcuaucgguacacggaucccagcacuccggaaugauuguuaacgacacgggucacgaaacagacgaaaaccgggccaaggucgaaauaacaccaaacagcccacgagcagaagccacccuaggaggcuucggcucccucggccucgacugcgaaccccguaccggcuuggacuucagcgaccuauacuaccucaccaugaacaacaaacacuggcugguccacaaagaaugguuccacgacauuccccuccccuggcacgcaggggccgacacaggaaccccacacuggaacaacaaagaggcccuuguagaguucaaagacgcacacgcaaaacgccaaacagucgucguccucggcucgcaagaaggagccguacacacagcacuagccggcgcacuagaagcagaaauggacggcgcaaaaggccgccuaagcucaggccaccucaagugccggcucaagauggacaaacuacgccuaaaaggagucucauacucccuaugcaccgcggccuucaccuucaccaaaaucccggcagagacccuacacggaaccguaaccguugaaguucaauaugccggaaccgacggacccugcaaaguacccgcccagauggcagucgacaugcaaacacuuaccccaguuggccgccucaucacggcaaaucccgucaucaccgaaaguacagaaaacucaaaaaugaugcuagaacuagacccgcccuuuggcgacucauacauagucauagggguaggagagaaaaagauaacccaccacuggcaccgcagcggguccacgauagguaaagccuucgaagcaaccguaagaggcgcgaaacgaauggcaguacuaggugacaccgcaugggacuucgggagcgucggcggggcacuaaauucacuugggaagggaauccaccaaaucuucggggccgcauucaagagucucuucggcggcaugagcugguucucacaaauccucauaggaacccuccuaauguggcuaggccucaacaccaaaaacggaagcauaucccuaaugugccuagcacucggaggcguacucaucuuccucagcacagcgguaagcgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10926 - RNA, 2290 nt, Artificial Sequence
  ZIKV (isolate Z1106033) prME-short variant mRNA Design 3 opt
gggagaaagcuuaccauggacuggacguggauacuauuccucguagccgccgcaacccgcguccacagcguaacccgaagaggcuccgcuuacuacauguaccucgaccgaaacgacgccggcgaagccauaucauuccccaccacccucggcaugaacaaaugcuacauccaaauuauggaccuagggcacacuugcgacgccacaaugagcuacgagugccccaugcucgacgaaggcgucgaaccagacgacguggacugcuggugcaacaccaccagcacauggguaguauacggaaccugccaccacaagaaaggcgaagcccgaagaucacgccgggccguuacccuccccucacacuccacacgaaagcuccaaacccgcucccaaaccuggcucgaaucucgagaauacacaaagcaccuuauaagaguugagaacuggaucuucagaaaccccggcuucgcccuagccgcagccgcaaucgccuggcuccucggcuccucaacaucccaaaaagucauauaccuugucaugauccuccucauagcaccagccuacucgauccgaugcaucggcguuuccaaccgcgacuuugucgaaggcaugaguggaggcaccugggucgacguaguacuagaacacggaggcugcgucacaguaauggcacaagacaaaccgacaguagacaucgagcuaguuacaacaaccguaucuaauauggccgaaguccgcucauacugcuacgaagccuccaucuccgacauggcauccgacuccagaugcccuacccaaggcgaagccuaccucgacaaacaauccgacacccaauacgucugcaaacgcacccucguagaccgaggguggggcaacgguugcggccuguucggaaagggaucccuagucacaugcgcaaaguuugccugcuccaagaaaaugacgggaaaaucaauacaacccgaaaaccuagaauaccgcauaaugcucagcguccacgggucacaacacagcgguaugauagugaacgacacuggacacgaaacagacgagaacagagcgaaagucgaaaucacaccgaacuccccucgcgcagaagccacgcuaggaggguucggaucacuuggacucgacugcgaaccccgcaccggccucgacuucagcgacuuauacuaccuaacaaugaacaacaaacauuggcuaguccacaaagaaugguuccacgacauaccccuacccuggcacgccggcgcagacacaggaacaccccacuggaacaauaaagaagcccucgucgaguucaaagacgcccacgcgaaaagacaaaccgucguuguacugggcagccaagaaggcgccguccacaccgcacuagcgggggcucuagaagcagaaauggauggcgccaaggggcgacuaucaucaggccaccucaaaugcagacuaaaaauggacaaacuccgccucaaaggaguaucauacucacuaugcaccgccgcguucacauucaccaaaauacccgcugaaacucuccacggaacagucaccgucgaaguccaauacgcaggaaccgacggccccugcaagguaccagcccaaauggccguagacaugcaaacacuaacccccgucggaagacuaaucaccgcgaaccccguaauaacagaauccacagagaacucaaaaaugaugcucgaacuagacccaccguucggagacucuuacauagucauaggagucggagagaaaaagaucacacaccacuggcaccgcucaggcucaacaauuggcaaagccuucgaagccacgguacggggagccaaaagaauggccguacuaggggacacagccugggacuucggaucagucggcggugcacuaaauucacuaggaaaaggcauccaccagaucuucggcgcagccuucaaaagccuauuugguggaaugucaugguucagccaaauccucauagggacccuccucauguggcucggccucaacgcuaaaaacggaagcaucucgcuaaugugccuagcccucgggggcguccuaauauuccucagcacggcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10927 - RNA, 2278 nt, Artificial Sequence
  ZIKV (strain MR 766) prME-short variant mRNA Design 3 opt
gggagaaagcuuaccauggacuggaccuggauacuguucuuaguagccgccgccacgcgaguccacagcauaacacgcaggggaucagcauacuacauguaccucgaccgauccgacgccggaaaagcaauaucauucgcaaccacgcuaggagucaacaaaugccacgugcaaaucauggaccuaggucacaugugcgacgccaccauguccuacgagugcccuaugcucgacgaaggaguagaaccagaugacgucgacugcugguguaacacaaccuccacaugggucgucuacggcacaugccaccacaagaaaggagaagccagacgaagccgucgcgccgucacacuaccaagccacagcacaagaaaacuccaaacccggucacaaacauggcuugaaagccgagaauauacaaaacaccucauaaaaguagaaaacuggaucuuccggaacccaggguucgcgcucguagccguggcaauagccuggcuccucggauccagcacaucccaaaaagucaucuaccuaguaaugauccucuugauagcacccgccuacucaauacgaugcauaggagucagcaaccgcgauuucguagaaggaauguccggcggaacaugggucgacgucguccucgaacacgguggaugcgucaccgucauggcacaagacaaacccacagucgacauagagcuagucaccacaacuguaagcaacauggccgaaguacgcuccuacugcuaugaagcauccauauccgacauggcaucggacagccgcugcccaacgcaaggcgaagccuaccuagacaaacaaucagauacccaguacgucugcaaaaggacccuaguagaccgaggauggggcaacggaugcggacucuucggaaaaggcagccuaguaaccugcgcaaaauucacaugcuccaagaaaaugacaggaaaaagcauacaaccggaaaaccuagaguacaggaucaugcuaagcgugcacggcucccaacacucaggaaugauaggcuacgaaaccgacgaagaccgagcaaaagucgaaguaacacccaacucaccccgggcagaagcaacccuagggggauucggaucccuaggacucgacugcgaaccccgcacaggacuggacuucuccgaccuauacuaccuaacgaugaacaacaaacacugguuaguccacaaagagugguuccacgauaucccccuaccauggcacgccggagccgacacaggaacgccacacuggaacaacaaagaagcccuagucgaguucaaagacgcacacgccaaaaggcagacagucguagugcuaggcucgcaagaaggggcaguccacaccgcacucgccggagcacuagaagccgaaauggacggagccaaggggcggcuauucucaggccaccugaaauguagacuuaagauggauaaacugcgacuaaaaggagugagcuacucccucugcacagccgcauucacguucacaaaaguaccggccgaaacacugcacgggacagucaccguugaaguccaauacgcagggacugacggccccugcaaaauccccguccaaauggccgucgacaugcaaacccuaacccccguaggacgacuaaucacggcaaacccuguaauaacagaaucaacagaaaacagcaaaaugaugcuugaacuagacccaccauucggagacuccuacaucguaaucggaguaggugacaagaagauaacacaccacuggcacagaagcggcuccacaaucgggaaagcguucgaagccacaguccgcggcgccaaaagaauggcuguacuaggagacaccgcaugggacuucggcuccguaggcggagucuucaacucgcuagggaaaggaauacaccaaauauucggagcagccuucaaaucccuauucggaggaauguccugguucucgcaaauccuaaucggcacacuccuggucuggcuaggacuaaacacgaaaaauggaagcauuucccuaacaugccucgcccucggaggaguaaugauauuccucagcaccgccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10928 - RNA, 2290 nt, Artificial Sequence
  ZIKV (strain NatalRGN) prME-short variant mRNA Design 3 opt
gggagaaagcuuaccauggacuggaccuggauacuauuccucguagccgccgcaacacgaguccacagcguaaccaggcgcggaucagccuacuacauguaccuggaccgaaacgaugccggcgaggcgauaucauuccccacaacccucggcaugaacaaaugcuacauccagaucauggaccucgggcauaugugcgacgccaccauguccuaugaaugcccgaugcucgaugaaggagucgaaccagacgacgucgacugcuggugcaacaccaccagcaccugggucguauacggaaccugccaccacaagaaaggcgaagcccgccgaagcagacgcgcagucacacuaccaagccacucaacacgaaaacuacaaacccgaucacaaaccuggcucgaaucccgagaauacacaaaacaccuaauccgagucgaaaacuggauauuccgaaacccaggauucgcccucgcggccgccgccauagccuggcuacugggauccagcacaagccaaaaagucaucuaccuugucaugauccuacuaaucgccccagccuacuccauacgaugcaucggagucagcaacagagacuucgucgaaggcaugucaggaggaacauggguagacguaguacucgaacacggcggcugcguaaccguaauggcccaagacaaacccacaguagacauagaacuuguaaccaccacagucuccaacauggcagaaguccgcucauacugcuacgaagcauccaucagcgacauggcaagcgacucacgcugcccaacccaaggcgaagcauaccuggacaaacaaagcgacacgcaauacgucugcaaaagaacacucguggaccgcggauggggcaauggaugcggccucuucggcaaggggagccuagugaccugcgcaaaauucgccuguucaaagaaaaugaccggcaaaagcauacaaccugagaaccucgaauaccgcauuaugcugagcguccacgggagccaacacagcggcaugaucguaaacgacaccggucacgaaaccgacgaaaaccgcgccaaagucgagaucaccccaaacucaccccgcgccgaggcuacacugggaggauucggcucacuagggcuugacugcgaaccgagaacaggcuuagacuuuucagaccuuuacuacuuaaccaugaacaacaaacacuggcucguccacaaagaaugguuucacgacaucccccugccauggcacgccggcgcugacaccgguacaccacacuggaacaacaaagaggcccuaguagaguucaaagacgcccacgcaaaacgccaaaccguagucguacuaggcucccaagaaggagcaguacacaccgcccuggccggagcacuagaagcagagauggacggagccaaggggcgccucagcuccgggcaccucaaaugucgccugaaaauggacaagcuaaggcuaaagggcguauccuacucccuaugcacagccgccuucaccuucaccaaaaucccagcagaaacccuccacggaacggugacuguggaaguccaauacgcaggaaccgauggacccugcaaaguacccgcacagauggcgguggacaugcaaacccuaacgcccgucggacgccucauaaccgccaacccagucauaacagaaucaacagaaaacagcaaaaugaugcucgagcucgacccacccuucggagacagcuacaucgucaucgggguaggcgaaaagaaaauaacccaccacuggcacagaucaggaucuacaaucggaaaagccuucgaagccaccguccgcggugcgaaacgaauggccguccuaggcgacaccgccugggacuucggcagcgucgggggcgcacucaacucccuaggaaaaggcauccaccaaaucuucggcgccgccuucaaaagccucuucggaggcaugucaugguucagccagauccucauaggcacacuccuaauguggcuaggccucaacaccaaaaacgggucaauuagccuaaugugccucgcacugggaggcgugcuaaucuuccuaagcaccgcagucucggcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10929 - RNA, 2308 nt, Artificial Sequence
  ZIKV (strain ZikaSPH2015) prME-short variant mRNA Design 3 opt
gggagaaagcuuaccaugggaaaaagaagcgcaggaucaauaauguggcuagcuucccuggccguaguaaucgccugcgcaggcgcaguaacacgucgaggguccgcauacuacauguaccucgauaggaacgacgcaggagaggcaaucucuuuccccaccacacuaggcaugaacaaaugcuacauccaaaucauggaccuaggacacaugugcgacgccacuauguccuacgaaugccccaugcuagacgaaggaguagaaccggacgacguugacugcuggugcaacaccacaucaaccugggucgucuacggaacaugccaccacaagaaaggagaagccagacgaagcagacgagccguuacacuaccaucccacagcacaagaaaacuacaaaccagaucacagaccuggcuagaaagcagagaauacaccaaacaucuaauccgagucgaaaacuggaucuucagaaaccccggcuucgcccuggcagcagccgcaauagccuggcuccucggcagcaguacaucccaaaaagugauauaucucgucaugauacuauugaucgcacccgcauacagcaucagauguauaggcgucagcaaccgugacuucguagagggaaugagcggcgggaccugggucgacaucguccuggaacacggcggaugcguaaccguuauggcacaggacaaacccaccguagacaucgagcuaguaacaaccacagucuccaacauggccgaaguacgcuccuacugcuacgaagcguccauaagcgacauggcaagcgacagccgcugcccaacccaaggggaggcauaccuagacaaacaaagcgacacucaguacgucuguaaaagaacacucguagacagaggauggggcaauggaugcggccuauucggaaaaggcagccucguaaccugcgccaaauucgcaugcaguaagaaaaugaccggaaaaagcauacaacccgagaaucuagaguaccggaucaugcucagcguacacggcucccaacacuccggaaugauaguaaacgacacaggacacgaaacagacgaaaaccgggccaaagucgagaucacaccaaacuccccaagggccgaagccacccugggcgguuucggcagccuaggacuagacugcgaaccccgcaccggccucgacuucagcgaccuauacuaccuaaccaugaacaacaaacacugguuaguccacaaagaaugguuccacgacauaccccucccguggcacgcaggcgcagacaccggcaccccucacuggaacaacaaagaagcacucgucgaguucaaagacgcccacgccaaaaggcaaaccgucgucguacucgggucacaagaaggagccguacacaccgcacuagccggagcccuagaagcagaaauggacggcgcaaaagggagacuauccuccggccaccucaaaugccgacugaaaauggauaaacuacgacuaaaaggcgucagcuacagccugugcaccgcagcauucaccuucaccaagauacccgccgaaacccuccacggaacagucaccgucgaaguccaauaugcaggaacagacggccccugcaaaguccccgcacaaauggccguggacaugcaaacccuuacaccaguaggaagacucaucacagcaaacccggucaucaccgaaagcacggaaaacucgaagaugaugcucgagcuagacccgcccuucggagauagcuauauaguaauaggaguuggagaaaagaaaauaacccaccacuggcacagaagcggguccacaaucggaaaagcauucgaagcgacaguacgaggggccaaacgaauggcaguccucggagacacagccugggacuucggauccguaggaggagcccuaaacucgcucggcaaaggcauacaccaaaucuucggcgccgcguucaaaucccuauucggaggcaugagcugguucagccaaauacuaauagguacccuacucauguggcucggacugaacaccaaaaacggaagcaucagucuuaugugccuagcacucggaggcguacuaauauuccuaucaacagccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10930 - RNA, 2308 nt, Artificial Sequence
  ZIKV (isolate Z1106033) prME-short variant mRNA Design 3 opt
gggagaaagcuuaccaugggcaaaagguccgccggaagcauaauguggcuggccagccuagcagucgugaucgcaugcgccggcgcgguaacacgccggggcucggcauacuacauguaccucgaccgaaacgacgccggggaagccaucagcuucccgaccacucucgggaugaacaagugcuacauacagauaauggaccuuggacauaccugcgacgcaacaaugagcuacgaaugcccaauguuagacgagggaguagaaccagacgacguggacugcuggugcaacacaacguccaccuggguagucuacggaaccugccaccacaagaaaggcgaggcgcgaagaagccgccgagccgucacacuacccagucacucaacacggaaacuacaaacaagaucacaaacauggcuagagagcagggaauacaccaaacaccucauccgagucgagaacuggauauucagaaacccaggcuucgcccucgccgccgcggcgauagccuggcuacucgggagcuccacaagccagaaaguaauauaccuagugaugauacuccuaauagcgccugcauacucgauccgaugcauuggaguaagcaaccgcgacuucguggaaggcaugucaggcggaaccuggguagacguaguccuagagcacggaggcugcguaaccguaauggcccaggacaaacccacagucgacaucgagcuagucacgacaaccgucagcaacauggcagaaguacguagcuacugcuacgaagcaucaaucucagacauggcaucagacagucgaugccccacacaaggagaagccuaccuagacaaacagucagacacacaauacgucugcaaaaggacccucgucgaccgaggcugggggaacgggugcggauuguucggcaaaggaucccucguuacaugcgcaaaauuugcauguucgaagaaaaugacugggaaaucaauacaaccggaaaaucuggaauacagaaucaugcuauccguacacggcagccagcacagcgguaugaucgucaaugacaccggccacgaaacugacgaaaacagagcaaaagucgaaaucacgcccaacagcccacgggcggaggccacacucggaggcuucggaucacuaggccuagacugcgaaccacgcaccggccuagacuucagugaccuauauuaccugaccaugaacaacaaacacuggcucguacacaaagaaugguuccacgacauaccccuaccguggcacgcgggggccgacaccgggacaccacacuggaacaauaaagaagcccuaguagaguucaaagacgcgcacgccaaacgccaaacagucguaguacucggcucacaagaaggagccguccacaccgcacucgcaggagcucucgaagcagaaauggacggagccaaaggacgacuuagcagcggacaccuaaaaugcagacucaaaauggacaaacucagauuaaaaggagucagcuacucgcuaugcacagcagcauucaccuucacaaagauccccgcggaaacccuacacgggacggucacaguagaaguccaauacgccggcacggacgggccaugcaagguucccgcacaaauggcggucgacaugcagacacugacaccagucggcagacuaauaaccgcgaaccccguaauaacagaaagcacagagaacucgaaaaugaugcuggaacuagacccaccguucggagacucauauauugugaucggaguaggagaaaagaaaauaacacaccacuggcaucgcagcgggagcacaaucggaaaagcauucgaagcuacaguccgcggcgccaaaagaauggcagugcucggcgacacggccugggacuucggaucaguaggcggagcccuaaacucacuuggaaaaggaauacaccaaauauucggcgcagcguucaaaagucucuucggcgggaugucaugguucagccaaauccucaucggcacccuacuaauguggcucggccuaaaugcaaagaacggcagcauaagccucaugugccuagcccuaggaggaguacuaaucuuccuaaguaccgccguaagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10931 - RNA, 2296 nt, Artificial Sequence
  ZIKV (strain MR 766) prME-short variant mRNA Design 3 opt
gggagaaagcuuaccaugggcaagcgaucagccggauccaucauguggcucgccagccuagcaguagucaucgcaugcgcaggggccaucacaagacgaggcuccgcguauuacauguaccuagaccguagcgacgccggaaaggcaaucagcuucgcaaccacccugggagucaacaaaugucacguacaaaucauggaccuaggacauaugugcgacgcaaccaugagcuacgaaugccccaugcuagacgaaggcgucgaacccgacgacguagacugcuggugcaacacaacuucaacaugggucgucuacggaacaugccaccacaaaaagggcgaagcaagacgcucccguagagccgugacccugccaagccacucaaccagaaaacugcaaacaagaucacaaacauggcuagaaagccgcgaguacacgaaacaccucauaaaaguagaaaacuggaucuuccgcaaccccggguucgcacucguagccgucgcaauagccuggcugcucggcuccagcacaucccagaagguaauauaccuagucaugauccugcucaucgcgccagcauacuccauacgaugcaucggcgucagcaacagagauuucguagagggaaugagcggcggcaccuggguagaugucguccuagaacacggaggcugcgucaccguaauggcacaggacaagcccacaguagacauagagcuagucacgacaacagucagcaacauggcagaaguaagaagcuacugcuaugaagcaucuaucagcgacauggcgagcgacagccgaugccccacgcaaggcgaggccuaccucgacaagcaguccgacacucaauacguaugcaaacgaacccucguagaccgggguuggggaaacggaugcgggcuauucggaaaaggcucccuaguaaccugcgccaaauuuaccugcuccaagaaaaugaccggaaaaucgauccaaccagaaaaccuggaauauagaauaaugcucagcguccacggcagccaacauucuggcaugauaggcuacgaaaccgacgaggacagggcaaaagucgagguaacgccaaacagcccaagggcagaagcgacccucggaggauucggcagccucggacucgauugcgaaccccgcacaggccucgacuucucagaccucuacuaccucacaaugaacaacaaacacuggcucguacacaaggaaugguuccacgacauaccacugcccuggcaugccggcgcugauacaggaacaccacacuggaacaacaaagaagcccucguggaguucaaagacgcccacgcaaaacgccaaaccguaguaguccuaggaagccaagaaggcgcgguacacacagcccucgccggagcccuagaagcagaaauggacggagccaaagguagacuauucucuggacaccucaaaugccgauuaaaaauggacaaacuccgacuaaaggguguaucauauagccuaugcacagcagccuucacauucacaaaggugccagcagaaacgcuucacgggaccgucaccgucgaaguacaguacgccggcacagacggaccgugcaaaauaccaguccagauggcaguagacaugcaaacacucacaccggucggcaggcuaauaacagccaacccaguaauaacagaaagcacagagaacagcaagaugaugcuagaguuagacccgcccuucggggacagcuacauaguaauaggcgucggagacaagaaaauaacacaccacuggcaccgaucaggcagcacgaucggaaaagccuucgaagcaaccguaaggggcgccaaaagaauggcaguacuuggagacacagcaugggacuucggaagcgucggcggaguauucaauaguuuaggcaaaggcauacaccagauauucggagccgccuucaaaucacuauucggagggaugucaugguucagccaaauccucauaggcacccuacucguauggcuaggccucaacaccaaaaauggcuccauaagucugacaugccucgccuuaggcggcguaaugauauuccuaucaaccgccguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10932 - RNA, 2308 nt, Artificial Sequence
  ZIKV (strain NatalRGN) prME-short variant mRNA Design 3 opt
gggagaaagcuuaccaugggaaaacgcucagcgggaucaauaauguggcucgccucccuagcagucgucaucgccugcgccggagccgucacucgccgcggcuccgcauacuacauguaccucgaccgaaacgacgccggagaagccauaucauuccccacaacccucggaaugaacaaaugcuacauccaaaucauggaccuaggccauaugugcgacgcaacgaugucauacgaaugccccaugcucgacgaaggaguagaacccgacgacguagacugcuggugcaacacaacgagcaccugggucgucuacgguaccugccaccacaagaaaggcgaagcccgcagauccagacgagcaguaacucucccaucccacagcacccgcaaacuacagacaaggucgcaaaccuggcucgaaagcagagaauacacaaaacaccucauccgcguagagaacuggaucuuccgaaaucccgguuucgcccuagcagccgcagcaauagcauggcuccucggcucaagcaccagucaaaaaguaauauaccuagucaugauacuccuaauagcacccgcauacagcauaagaugcaucggcguaucgaaccgcgacuucgucgagggaauguccggaggaacguggguugacguaguacuagagcacggcgggugcguaacuguaauggcccaagacaaacccacaguugacauagagcucgucaccacaacggucucaaacauggccgaaguccggaguuacugcuaugaagcgagcaucagcgacauggcauccgacucccgaugccccacacaaggcgaagccuaccuagacaaacagucagacacacaauacgucugcaaacggacacucgucgacagaggauggggcaacggcugcggccucuucggcaaaggcagccuugucaccugugcgaaauuugccugcagcaagaaaaugaccggcaaauccauacaacccgaaaaccuggaauaccgaaucaugcugucaguccacggaucccaacacagcggaaugaucguuaacgacacaggucacgaaaccgacgaaaauagagccaaaguagaaauaacaccgaacagcccccgagccgaagccacacuaggagguuuuggcucccucggccucgacugcgagccacgcaccggacucgauuucucagaccucuacuacuuaacgaugaacaacaaacacuggcucguccacaaagaaugguuccacgacaucccccucccauggcacgcaggagcagacacaggcacaccacacuggaacaacaaggaagcccuagucgaguucaaagacgcccaugccaaacgccaaaccguagucgugcucgguucacaagaaggcgccguccacacggcacucgccggagcacucgaagccgaaauggacggcgcaaagggacgacuauccucaggccaccucaaaugcagacucaaaauggacaaacuaaggcuaaaaggcguaagcuacucccuauguacagcagcauucacauucaccaaaaucccagcagaaacacuucacggcacagucacaguagaaguccaauacgccgggacagacgggccaugcaaagugccggcacagauggccguagacaugcaaacccuaacccccguaggccgucucaucaccgccaacccaguaaucaccgaaagcaccgaaaacuccaaaaugaugcuagaacucgacccacccuucggggacaguuacaucguaaucggaguaggggaaaagaaaaucacccaccacuggcaccgauccggcuccaccaucgggaaggcuuucgaagcaacgguacgcggcgcaaaacggauggcgguacucggagacacagccugggacuucggcagcgucggcggagcccugaacucacuagggaaaggaauacaccaaaucuucggcgccgccuucaaaucgcuauucgggggcaugagcugguucucacaaaucuuaaucggaacccuacucaugugguugggccugaacaccaagaacggauccaucucacugaugugucuagcucucggcgggguacucaucuuccugagcaccgcagucagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10933 - RNA, 2311 nt, Artificial Sequence
  ZIKV (strain ZikaSPH2015) prME-short variant mRNA Design 3 opt
gggagaaagcuuaccauggccaucucaggcguaccaguccuaggguucuucaucaucgccguccucaugagcgcccaagaauccugggccguaacccgccgaggauccgccuacuacauguaccuagacagaaacgacgcaggagaagccaucuccuucccgacaacacucggaaugaacaaaugcuacauacaaaucauggaccucggccacaugugcgacgcaacaaugagcuacgaaugucccaugcuagacgaaggagucgaacccgacgacgucgacugcuggugcaacacuaccagcaccuggguggucuacggaaccugccaccacaaaaagggcgaagcacgacgaaguagacgcgccgucacccuccccagccacucaacacguaaacuacaaacccgaagccagaccuggcucgaaagccgagaauacaccaaacaccucaucagaguagaaaauuggaucuucagaaaccccggguucgcacuggcggcagccgccaucgccuggcuacucggaucuagcacgucccaaaaggucauauaccuggucaugauccuacuuaucgccccagcauacuccauccgcuguauaggcguauccaaccgugacuuugucgaaggcauguccggcggaaccugggucgacauaguccucgaacacggcggaugugucaccguaauggcacaggacaaaccaacagucgacaucgagcuaguaaccaccaccgucuccaauauggcagaaguaagauccuacugcuacgaagccucaaucagcgacauggccucagacagccgaugccccacacaaggcgaagcauaccuagauaagcagucagacacccaguacgucugcaagcgcacccuagucgaccgcggauggggaaacggcugcgggcuauucggaaaaggaagccuaguaaccugcgccaaguucgcuuguucaaagaaaaugaccggaaaauccauacaaccagaaaaccucgaauaccgcaucaugcuauccguacacggcucacaacacagcggcaugauaguaaacgacaccggacacgaaaccgacgaaaaccgggccaaagucgaaauaacaccgaauagcccccgcgccgaagcaacccucggcggauucggaucccucggguuagacugcgagccccgcacuggccucgacuucuccgaccuauacuaccucaccaugaacaacaaacacuggcugguccacaaagagugguuccacgacaucccccugccauggcacgcaggagccgacaccggcacaccccacuggaacaauaaagaagcucuaguagaguucaaggacgcacaugcaaaacgacaaaccgucgucguccuaggcucccaagaaggagcaguacacaccgcccucgcaggagcccucgaagccgaaauggacggagccaaagggcgacucuccucaggacaccuaaaaugucgccuaaaaauggacaagcuaaggcucaaaggaguaagcuacucccucugcaccgcggcauucaccuucacaaaaauccccgcugaaacacuccacggcaccgucacaguggaaguacaauacgccggaacagacgggccgugcaaaguaccagcccaaauggcggucgacaugcagacccucaccccagucgggcgccucaucacggccaacccaguaauuacggaaucaaccgagaacuccaaaaugaugcucgaacuggaucccccauucggcgacagcuacaucgucaucggcguuggcgaaaagaaaauaacacaccacuggcacagauccggcagcacacucggcaaagcguucucuacaacacucaaaggugcacaacgacuagcugcacucggcgacacagcaugggacuucggauccaucggcggagucuucaacuccaucgggagagcaguccaccagguuuucgggggcgccuuccgaacacuauucggagggaugagcuggaucacgcaaggacuaaugggagcccuccuacuauggaugggcguaaaugcaagagaccggagcauagcacucgccuuccuagcaaccggaggcguccucgucuuccuagccacaaacguccacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10934 - RNA, 2311 nt, Artificial Sequence
  ZIKV (isolate Z1106033) prME-short variant mRNA Design 3 opt
gggagaaagcuuaccauggccaucagcggcguccccguccuaggcuuuuucaucauugccguacucaugucagcccaagaaagcugggccguaacccgacgcggcagcgccuacuacauguaccuagaccgaaacgaugcaggggaagcaaucuccuuccccaccacgcuaggaaugaacaaaugcuacauucaaauaauggaccucggccauaccugcgacgccaccaugucauacgagugccccauguuagacgaaggaguagaacccgacgauguggauugcuggugcaacacaacaagcaccugggucguguacgggaccugccaccacaagaaaggagaagcgcgcagaucacgcagggcagucacgcuacccagccacucaacacggaaacugcaaacccgcucccaaacauggcuagagucacgggaauacaccaaacaccugauccgagucgaaaacuggaucuuuagaaacccaggauucgcccucgccgcagcugcuaucgccuggcuccucgggucaucaacaucccagaaaguuaucuaucucguaaugauccuccuaaucgcccccgccuacuccauccgcugcauaggagugaguaacagagacuucguggaaggcauguccggcgggacauggguagacgucguacucgaacacgggggaugcguaacagugauggcucaagauaaaccaacaguagacaucgaacucguuacgacaaccgucagcaacauggcagaaguccgaagcuacugcuacgaggcaagcauaagcgacauggccucagacagccgaugcccuacccaaggcgaagcauaccuagacaaacaaagcgacacccaauacgucugcaaaagaacgcucguggaccguggcuggggaaacggcugcggccuauucggaaaaggaagucugguaaccugcgccaaauucgcgugcuccaagaaaaugaccggcaaauccauccaaccugaaaaccucgaauaccggaucaugcuauccguccacggcagccaacacucaggcaugaucgucaacgacacaggacacgaaaccgacgaaaaucgagccaaaguagaaauaacacccaacagcccaagagcagaagcaacacuaggcggauucgggagccucggacucgacugcgagccacgcacagggcuagacuucucagaccucuacuaccuaaccaugaacaacaaacacuggcucguccacaaagaaugguuccacgacauaccacuccccuggcacgcaggggccgacaccggcacgccacacuggaacaacaaagaggcacuuguagaguucaaagacgcccacgcaaagcgacaaaccgucguaguucucggaucccaagaaggcgccguccacacggcccucgccggagcacuagaagcagaaauggacggcgccaaaggaaggcuaaguuccggccaccucaaauguagacucaaaauggacaaacuucgacuaaaaggagucagcuacagcuuaugcaccgccgcauucacauucacaaaaaucccagcagaaacacuacacggaaccgucacagucgaaguacaauacgcgggcacagacggcccauguaaggugcccgcccaaauggcaguggacaugcaaacccuaacccccguagggcgacucaucacggcaaacccagucaucaccgaaagcacagaaaacagcaaaaugaugcucgaacucgacccaccuuucggggacuccuacauagucaucggcgucggcgaaaagaaaauaacccaccacuggcacagaucaggcaguacccuuggaaaagccuucucaaccacuuuaaaaggugcacaaagacuagcugcacucggcgacaccgcaugggacuucggcucgauaggcgggguauucaacagcauaggacgagcgguccaccaagucuucggcggcgcauuccggacacuguucggaggaauguccuggauaacccagggacucaugggggcccuacuccucuggaugggaguaaacgcgagagaccgcuccaucgcccuagcauuccuagccacaggaggcguccuaguuuuccucgcaacaaacguacaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10935 - RNA, 2299 nt, Artificial Sequence
  ZIKV (strain MR 766) prME-short variant mRNA Design 3 opt
gggagaaagcuuaccauggccaucucagggguaccaguacuaggcuucuucaucauagccguccucaugucagcccaagaaucaugggcgauaacacgccgaggcagcgcuuacuauauguaucucgaucgaagcgacgccggaaaagccaucaguuucgcuaccacucuaggaguuaacaaaugccacguacaaaucauggaucugggccacaugugcgacgccaccaugagcuacgagugcccaaugcucgacgaaggaguagaaccggacgacgucgacugcuggugcaacaccaccaguacauggguugucuacggcacuugccaccacaagaaaggagaagcccgacgaucccgccgcgcggucacucuccccucccacuccacacgaaaacuccaaacccgcucacaaacguggcuagagucgcgagaauacaccaaacaccucauaaaaguagaaaacuggaucuuccgcaacccaggcuucgcacucguagcgguugcgaucgcguggcuccuaggcuccuccacuucccaaaaagucaucuaccuaguuaugauccuccuaaucgccccagccuacagcauccggugcaucggagucucaaacagagacuucgucgaagguaugagcggcggcacauggguagacgugguccucgaacacggcggaugcgucacaguuauggcgcaagacaaacccaccguagacaucgaacucgucacgaccaccgugucaaacauggccgaaguccgaagcuacugcuacgaagcaucaauaucagacauggccuccgacucccguugcccaacgcaaggagaagccuaccucgacaaacaaagcgacacccaauacguuugcaaacgcacccuagucgaccgcggcuggggcaacggaugcggccucuucggaaaaggcucccucgugacaugcgcaaaauucacaugcagcaagaaaaugacaggaaaaucaauccaacccgaaaaccucgaauacagaaucauguugucaguacacggcagccaacacucaggaaugauaggauacgaaacggacgaagaccgcgcaaaagucgaagucaccccaaacagccccagggccgaggcgacccuuggaggauucggcagccucggacucgacugcgagccccgcacaggccucgauuucagcgaucuauacuaccuuaccaugaauaacaaacacugguuaguccacaaagaaugguuccacgacauaccccuccccuggcacgcgggagcggacaccgguaccccacacuggaacaacaaagaagcacucgucgaguucaaagacgcccacgccaaaaggcaaacaguaguaguccucggaagucaagaaggcgccguccacaccgcacuggccggcgcccucgaagccgaaauggauggagccaaaggccgacucuucucaggacaccucaaaugccgacucaaaauggacaaacucagacuaaaaggaguauccuacagccuuugcacagccgccuucacguucacaaaaguccccgccgaaacacuucacggaacggucacagucgaaguacaauacgccggcaccgacggccccugcaaaauccccguucaaauggcgguggacaugcaaacucucacaccuguaggacgacuaauuaccgccaaccccgucaucacugaauccacagaaaacagcaaaaugaugcuagaacucgaucccccauucggcgacagcuacauaguaaucggugucggcgacaagaaaaucacacaccacuggcaccgcagcggcuccacacuuggaaaagcauuuucaaccacccucaaaggcgcacaaagacuagccgcgcucggagacacagcaugggacuucggcucgaucggcggagucuucaacuccauaggacgagccguccaccagguauucggcggagccuuccgcacacuguucggaggcaugagcuggaucacucaaggacucaugggagcgcuccuacucuggaugggcgucaacgcccgcgaccgaagcauagcuuuagccuuccucgccacaggaggcguccucgucuuccucgcgaccaacguacacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10936 - RNA, 2311 nt, Artificial Sequence
  ZIKV (strain NatalRGN) prME-short variant mRNA Design 3 opt
gggagaaagcuuaccauggcgaucuccggcguaccaguccuaggauucuucaucaucgcaguccucaugucugcacaagaaucaugggcaguaacaagacgcggguccgcauacuacauguaccucgaucgaaacgaugccggcgaagccauauccuuccccacaacacuaggcaugaacaaaugcuacauccaaaucauggaccuaggacacaugugcgacgcaacaauguccuacgaaugcccaaugcuggacgaggggguggaaccagacgacguagauuguuggugcaacacaaccuccaccugggugguauacggaacgugccaccacaaaaagggagaagcccgacgcagccgacgagccgugacccuacccucccacagcacacgaaaacuacaaacacgcagccaaacauggcuagaaagcagagaauacaccaaacaccuaauacgcguagaaaacuggaucuuccgcaacccaggcuucgcacuggccgcagccgccaucgcauggcuccucggcagcucaaccucccaaaagguaaucuaccuuguuaugauccuccuaaucgcaccggcguacuccauaagaugcaucggcgucucaaauagggacuucguagaaggcaugagcgggggaacguggguagacguaguccucgaacacggaggcugcguaaccgugauggcacaagacaaaccaacgguagacaucgagcuaguaacaacaaccgucuccaacauggcugaagucagauccuacuguuacgaagccagcauaagugacauggccucagacucacgcugccccacacaaggcgaagcauaccuagacaaacaauccgacacccaguacgucugcaagcgaacccucgucgacagaggcuggggcaacggauguggccuauuuggaaagggaagccucguaaccugcgcuaaauucgccugcucaaagaaaaugacaggcaaaagcauccaacccgaaaaccuggaauaccgcaucaugcuaagcguccacggcagccaacacucagggaugauaguaaaugauaccggacacgaaacagacgaaaaccgagcaaaaguggaaauaacaccaaacucgccacgggccgaagccacgcuagggggcuucggcucacuagggcucgauugcgagccaagaaccggacuagauuucagcgaccuauacuaucuaacgaugaacaacaaacauuggcuaguacacaaagaaugguuccacgacaucccccuaccauggcacgccggcgccgacaccggcacaccacacuggaacaacaaagaagcacucguggaguucaaagaugcccacgccaaaagacaaacagucgugguacuaggcagucaagaaggcgccgugcacacagcucuugcgggagcccuagaagccgaaauggacggcgccaaaggaagacuaagcuccgggcaccucaaaugccgacuaaaaauggacaaacucagacugaaaggcgucagcuacucacucugcacagcagccuucacauucaccaaaauucccgcagaaacacuacacggcacaguaaccgucgaaguccaauacgcaggcacagacggccccugcaaaguccccgcacaaauggccguagacaugcaaacacuaacacccguaggucgacuaauaaccgcgaacccagucaucacagaauccacugaaaacagcaaaaugaugcuagaacucgacccgccauucggagacucauacaucguaaucggagucggagagaagaaaauaacacaccauuggcaccgcucgggcuccacacuaggcaaagccuucagcacaacccucaaaggagcacaaagacuggccgcacucggcgacaccgcgugggacuucggcagcaucggaggcguguucaacucaauaggacgugccguacaccaagucuucggcggagccuuccgaacacuauucggcgggaugucauggauaacccaaggccuaaugggcgcccuacuccuauggaugggaguaaacgcacgggaccgcucgauagcacuagcuuuccucgcaacgggcggcguccuaguguuucuagcaacaaacguucacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10937 - RNA, 2290 nt, Artificial Sequence
  ZIKV (strain ZikaSPH2015) prME-short variant mRNA Design 3 opt
gggagaaagcuuaccauggacuggaccuggauacuauuccucguagccgccgccacccggguccauucagucacccgccgaggcucugccuacuacauguaucuggacagaaacgacgccggcgaagcaauuagcuucccaacaacccucggaaugaacaaaugcuacauacaaauaauggaccucggccacaugugcgacgcaaccaugucauacgagugcccaaugcuggacgagggagucgaacccgacgacguagacugcuggugcaacaccaccagcaccugggucguauacggcacaugucaccacaagaaaggggaagcccgacguagccgcagagcaguaacccuaccaagucauucaacacgcaaacuccaaacaaggagccaaaccuggcuagaaucacgggaguacacaaaacaccucauacgaguagaaaacuggaucuucagaaacccgggguucgcccucgcagccgccgccauagcauggcuucucgggucaagcaccucccaaaaaguaaucuaccucgucaugauacuacuaaucgcaccagcauacagcauacgaugcaucggcguaucaaacagagacuucguagaaggcaugaguggagggaccuggguugacauaguacuggaacacggcggaugcgucacagucauggcacaggacaaaccaaccgucgacauagagcuuguuacaaccacggucagcaacauggccgaaguccgaagcuacugcuacgaggcaagcauaucagacauggccucagacagccgaugcccaacgcagggagaagcauaccucgacaaacaaagcgacacgcaauacgucugcaaaaggacgcuuguagaccgcggcuggggaaacggaugcggccucuuuggaaaaggaucucuaguaaccugcgcaaaguucgcgugcucaaagaaaaugacuggaaaaucaauccaacccgagaaccucgaauaccgcaucaugcuauccguccacgggucacaacacagcggaaugaucguaaacgacacaggacacgaaacagacgaaaacagggccaaaguagagaucaccccgaacagcccaagagccgaagcaacacuaggcggcuucggcagucuuggacucgacugcgaaccgcggacuggacuggacuuuagcgaccuguacuaucucaccaugaacaacaaacacuggcuaguacacaaagaaugguuccacgacaucccgcucccauggcacgcaggcgccgauaccggaaccccucacuggaacaacaaagaagcccucguagaguucaaagacgcccacgccaaacgacaaacaguagucgugcucggaagccaagaaggagcgguacacacggcacucgcgggagcccuggaagcggaaauggacggcgcaaaaggacgacuaucaagcggucaccucaaaugccgacuaaaaauggacaagcuacgccucaaaggcgucagcuauagccuaugcacagccgcauucacauucacaaaaauaccggccgaaacacuacacggcaccgucaccgucgagguacaauacgcagguaccgacggacccugcaaagucccagcccagauggcagucgacaugcaaacccucaccccugucgggaggcuaaucaccgcaaaccccguaauuacagaaucaacagagaacagcaaaaugaugcuggaacuggacccacccuucggcgacuccuacaucgucaucggaguaggugaaaagaaaaucacccaccacuggcaccgaagcggcucaacccuaggcaaagccuucagcacaacccuaaaaggagcccaacgccucgccgcccucggcgauacggcgugggacuucggcuccauaggaggcguauucaauucaaucggccgcgccguacaccaagucuucggcggagcauuccggacacucuucggaggaaugagcuggauaacgcaaggacucaugggcgcauuacucuuauggauggggguaaacgcccgagaccguagcaucgccuuagccuuccucgccacaggcggagugcuaguauuccucgcaacaaacguccacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10938 - RNA, 2290 nt, Artificial Sequence
  ZIKV (isolate Z1106033) prME-short variant mRNA Design 3 opt
gggagaaagcuuaccauggacuggaccuggauacucuuccugguagccgcagcuacccgcguacacucagucacacgccgaggaucggccuacuacauguacuuagaccgcaacgacgcuggcgaagcaauaucauuccccacaaccuuaggcaugaacaaaugcuacauacaaaucauggaccugggccacacaugugacgcgaccauguccuacgagugcccaaugcuggacgaaggaguagagccggacgacguagacugcuggugcaacaccaccagcacauggguagucuacggaaccugccaccacaagaaaggcgaggcccgccgaagccgaagggcagucacccucccaagccacuccacccgaaaacuacagacccgcucccaaaccuggcuagaaucucgugaauacacaaaacaccucaucaggguagaaaacuggaucuuccgcaaccccggcuucgcacucgcagcagccgcaaucgcuuggcuacugggcuccuccaccucacaaaaaguaauauaccuggucaugauccuacugaucgccccagccuacagcauccgcugcaucggcguaagcaaccgggacuucguagaaggcaugucuggcgggaccuggguagacgucgugcuagagcacggcggcugcgucacaguaauggcacaagacaagcccacagucgacaucgaacucgucaccaccaccguaagcaacauggcagagguccgcuccuauugcuacgaggccagcauaucagacauggcaagcgacagccggugcccaacccaaggcgaagcauaccucgauaaacaauccgacacgcaauacguaugcaaacgaacacucgucgacagaggcuggggaaacggaugcggccuauucggaaaaggaucccuagucaccugugccaaauucgccugcaguaagaaaaugacaggcaaaagcauacaaccagaaaaccuagaauaccgaaucaugcucuccguacacggaagccaacacucaggaaugaucgucaacgacacugggcacgaaaccgaugaaaaccgugcaaaaguagaaauaacgcccaacucaccacgcgcagaagccacccugggaggcuucggcagccuaggacucgacugcgaaccaagaacuggccucgacuucucagaccucuacuaccucaccaugaacaacaaacacuggcucguacacaaagagugguuccacgacaucccccuaccauggcacgcuggggcggacacaggcacaccccacuggaacaauaaagaagcccuaguagaguucaaagacgcacacgcaaaacgacaaaccguagucguacuuggcagccaggaaggugcgguccauaccgcacuagccggcgcccucgaagccgaaauggacggcgcuaaaggucgccucucaagcggccaucuaaagugccgacuaaaaauggacaaacuccgucucaaaggagucuccuacagccugugcaccgcagcauucaccuucacaaaaaucccagcggaaacccuccauggaaccgugaccgucgaaguccaauacgcaggaacagauggacccugcaagguccccgcccaaauggcaguagacaugcaaacacugacccccgucggccgacucauaacggccaacccagucauaacugaauccacagaaaacucaaaaaugaugcuggagcucgacccgcccuucggcgauagcuacauagucaucggcgugggcgaaaagaaaauaacucaccacuggcaccgcagcggcaguacacuaggcaaagccuucaguaccacccugaaaggagcccaacgacucgcagcccucggagacacagcaugggacuucgguagcaucggcggcgucuucaacuccaucgggagagccgugcaccaaguguucggaggcgccuuccguacccucuucggaggaaugucauggauaacucaagggcucaugggcgcccuccuacucuggaugggaguaaacgccagagacagaagcaucgcccuagccuuccuagccaccggcggaguacucguauuccuggcaaccaacguccacgcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10939 - RNA, 2278 nt, Artificial Sequence
  ZIKV (strain MR 766) prME-short variant mRNA Design 3 opt
gggagaaagcuuaccauggauuggaccuggauccuguuccucguagccgccgccacacgcguacauucaauaacacgccgaggaucggcauacuacauguacuuggaccguagcgacgcaggcaaagcgaucuccuucgccacaacccugggcgucaauaaaugccacguacaaaucauggaccuuggacacaugugcgacgccacaaugucauacgaaugccccaugcuggacgagggcguagaaccagacgacgucgacugcuggugcaauaccacaagcacaugggucguuuacggcacaugccaccacaagaaaggggaagcgcgacggucccgacgagcggugacacuaccaucccacagcacacgcaaacuacaaacaaggagccaaaccuggcucgaaagccgagaguacacaaaacaccuaauuaaaguagaaaacuggaucuuccgcaauccaggauucgcgcuaguagcagucgccauagccuggcuacuaggaagcagcaccucccagaaagucaucuaucuagucaugauccucuuaauagcacccgcguacaguauacgaugcauaggcguaagcaacagggauuucguagaaggaaugucgggagggaccuggguagacgucgugcucgagcacggcgggugcguaaccguaauggcccaagacaaacccacagucgacaucgaacucguuacaaccacaguuagcaauauggccgaaguaaggucauacugcuacgaagcaucgaucagugacauggcaucagacucacggugccccacgcaaggcgaagcauaccuagacaaacaaagcgacacccaauacgucugcaaacgaacacucgucgaccgaggcuggggaaacgggugcggacucuucggcaaaggcucgcugguaaccugcgcaaaauuuacauguucaaagaaaaugacaggcaaaagcauucaacccgaaaaccucgaguaccgaaucaugcuaucaguccacggaagccaacacagcggaaugaucggguaugaaaccgacgaggacagagccaaaguagaaguaacgccaaacagcccccgggccgaagccacacugggcggauucggaagccucggccuggacugcgaacccagaacaggccuggacuucagcgaccuauacuaccuaaccaugaacaacaaacacuggcucguacacaaagagugguuccacgacaucccccucccauggcacgcaggagccgacaccggcacaccccacuggaacaacaaagaagcccuggucgaguucaaagacgcccacgcgaaacgacagaccguagucgugcuaggaagucaagagggggcaguacacacagcccucgccggagcacucgaggccgagauggacggcgcaaaaggacgccucuucucgggacaccuaaaaugccgccucaaaauggauaaauuaagacuaaaaggcgucucauacucguuaugcaccgccgcauucaccuucaccaaaguccccgccgaaacccuacauggaacaguaaccguggaaguacaguacgcggggaccgacggacccugcaaaaucccaguccagauggcggucgacaugcaaacccugacgcccgucggacgccuaauaacggcuaacccggugauaaccgaauccacagaaaacucaaaaaugaugcucgaacuagacccaccauucggagacagcuacaucguaauaggagucggcgacaagaaaaucacccaccacuggcaccgaaguggauccacacuaggcaaagcauucucaaccacacucaaaggggcccagcggcucgccgcccuaggagacacagcaugggacuucggaucaaucggagguguauucaacucgauaggcagagccguccaccaaguauucggaggggcauuccgaacacuauucgggggaaugagcuggaucacacaaggacucaugggagcccugcugcuuuggaugggcguaaacgccagagaccgaucaauagcccuagcauuccuugcaacaggaggcguccucgucuuccuagcaacaaacguacacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10940 - RNA, 2290 nt, Artificial Sequence
  ZIKV (strain NatalRGN) prME-short variant mRNA Design 3 opt
gggagaaagcuuaccauggacuggacauggauccucuuucucguagcggccgcaacccgaguccacagcgugacccgccgcggcuccgccuacuacauguaccucgacagaaacgacgccggcgaggcaaucuccuucccgaccacccucggaaugaauaaauguuacauacaaaucauggaccucgggcacaugugcgacgcaaccaugagcuacgaaugccccaugcuggacgaaggaguagaaccagacgacgucgauugcuggugcaacaccacaagcaccuggguaguauauggcacaugucaccacaaaaagggggaagcccgccgcucacgccgcgccguaacacucccaucacacagcacccgcaaacuccaaaccagaucccaaaccuggcucgaaucaagagaguacacaaagcaccuaauacgcguagaaaacuggauuuucagaaacccaggcuucgcucuugcagccgccgcgaucgccuggcuccucggcuccaguacaagccagaaggucaucuaccucguaaugauccuccuaaucgcaccagccuacuccauacgcugcauagguguaucaaaccgagacuucguagaaggaaugagcggcggaacaugggucgacguaguacuagaacacggcggcugcgucacagucauggcacaggauaaaccaacggucgacaucgaacucguaaccacaacaguaagcaacauggcagagguccgaagcuacugcuacgaggccuccauauccgacauggcauccgacuccaggugccccacccaaggagaagccuauuuagacaaacaauccgacacccaauacgucugcaaaagaacacugguggaucgaggaugggggaacggcugcggauuauucggaaaaggaucacucguaaccugcgcaaaauucgcaugcagcaagaaaaugacaggcaaaagcauccagccggaaaaccucgaauaccgcaucaugcuaucaguacacggaucccaacacuccggcaugaucgugaacgacacaggacacgaaacggacgaaaaccgggccaaggucgaaauaacaccuaacucaccccgagccgaagcgacucucggaggguucgggagccucggccucgacugcgagccacgcaccggccuagacuuuucagaccucuauuaccucaccaugaacaacaaacacuggcuaguccacaaagaaugguuccacgacaucccacuaccuuggcacgccggcgccgacacaggcacaccccacuggaauaacaaagaagcacuggucgaauuuaaagacgcacacgccaaacgacaaacagucgucguacuaggaucacaagaaggagcaguucacaccgcccuagccggagcacuugaagcagaaauggacggagcaaaaggacgccuuagcucaggacaccuaaagugcaggcugaagauggacaaacugagacucaaaggagucuccuacucacugugcaccgcagccuucacauucacaaagauccccgcagagacucuccacggaaccgucaccgucgaaguacaauacgcaggaacagacggcccuugcaagguccccgcccaaauggcagucgacaugcagacacucaccccagucggaagacucaucacagccaaccccgucauaaccgaauccaccgaaaacucaaaaaugaugcucgaacuggacccacccuucggugacagcuacaucgucauagggguaggagaaaagaaaaucacacaccacuggcaccgcucaggauccacccucggaaaagccuucucaaccacacucaaaggcgcacaaagacucgcggcacucggagacaccgcgugggacuucggauccaucggcggcguauucaacagcauaggacgcgcaguccaccaaguauucggaggagccuuucgaacacucuucggcggaaugucauggaucacccaaggccuaaugggcgcccuacuccucuggaugggagugaacgcccgcgaccggagcaucgcacuagcuuucuuggcaacaggcggcguccuaguauuccuggccaccaacguacacgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10941 - RNA, 2308 nt, Artificial Sequence
  ZIKV (strain ZikaSPH2015) prME-short variant mRNA Design 3 opt
gggagaaagcuuaccaugggcaaaaggucagcgggcagcaucauguggcucgccucccucgcuguagugaucgccugcgcaggagcgguaacgcgccgaggcucagcauacuacauguaucuggaccgaaacgaugccggagaagcaauauccuucccaacaacacuaggcaugaacaaaugcuacauacaaauaauggaccuaggccacaugugcgacgcaacgaugucauacgaaugcccaaugcucgacgaaggcguugaaccagacgacgucgacugcuggugcaacacaacgagcacgugggucguauacggcacaugccaccacaagaaaggagaagcacgccggagccgucgggcagucacccugccaucccacuccacaagaaaacuccaaacacgaagccagacauggcucgagagcagagaauacaccaaacaccuaaucagagucgaaaacuggauauuccgaaaccccggguucgcgcucgcagccgccgcaaucgccuggcuacuaggaucaucaaccagccaaaaaguaaucuaucuaguaaugauacuacuaauagccccggcguacuccauaagaugcauaggcgucaguaaccgagauuucguagaaggaaugucaggagggacaugggucgacaucguacuagagcacggcggcugcgugaccguaauggcacaggacaaaccaacgguagacaucgaacucgucaccacaaccguaaguaacauggcagaagugagaucauauugcuacgaagccuccauaagcgacauggccagcgacucuagauguccaacgcaaggagaagcguaccucgacaaacaguccgacacgcaauacgucugcaaacgcacacucguggaccgcggcuggggaaacggaugcggacuauucggaaaagggucccuagucacaugcgcaaaauuugcgugcucaaagaaaaugacaggcaaauccauccagccagaaaaccuagaauacagaaucaugcucuccguacacggcucccaacacagcggaaugaucguaaacgacacaggacaugaaacggacgagaacagagcaaaagucgaaaucacgcccaauagcccacgcgccgaagcaacccuuggaggcuucggcagcuugggccuugacugcgaaccacgcacggggcuagacuucucagaccuauacuaccuaacaaugaacaacaaacacuggcucguccacaaagagugguuccacgacaucccccucccguggcacgccggcgcagauaccggcacaccccacuggaacaacaaagaagcccuagucgaguucaaagacgcacacgccaaaagacaaacagucgugguacuaggaucccaagaaggagcaguccacacagcgcuagcaggcgcccuagaggccgagauggauggagcgaaaggacgucuauccucaggacaccuaaaaugcaggcuaaaaauggacaaacuacgacuaaaaggcgucucuuacucacuaugcacagccgcauucacauuuaccaaaaucccagcggaaacacugcacggcacaguaaccguagaaguacaauacgcaggcaccgacggacccuguaaggucccagcccaaauggcagucgacaugcaaacacugaccccggucggacgccugauaacagccaacccaguaaucacagaaucgacagaaaauuccaaaaugaugcuagaacuagaucccccauucggcgacagcuauaucgugaucggaguaggggaaaagaaaaucacccaccacuggcaccgauccgggagcacgcucggaaaagcguucucaaccacacugaaaggggcacagcggcucgcagcacucggcgacaccgcaugggacuucgggucaaucggaggcgucuucaacuccaucggacgagcaguacaccaagucuucggaggcgcguucagaacauuauuugggggcaugagcuggaucacacagggccucaugggcgcccuacuccucuggaugggggugaacgccagagacagauccauugcacuagcguuccuagcaacgggcggcguacucguauuccuagccacaaacguccaugccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10942 - RNA, 2308 nt, Artificial Sequence
  ZIKV (isolate Z1106033) prME-short variant mRNA Design 3 opt
gggagaaagcuuaccauggggaaaagaucagcaggcuccaucauguggcucgccucacucgcaguagucauagcaugcgcaggcgcggucaccagacgaggcucagcguacuacauguaccuugacaggaacgacgcaggagaagccaucagcuucccgaccacacucggcaugaacaaauguuacauccaaaucauggaccuaggacauaccugcgacgccacaaugucauacgaaugcccaaugcuagacgaaggcguagaacccgacgacgucgacugcuggugcaacaccacgagcaccugggucgucuacggcacaugccaccacaagaaaggagaagcccgccgaucccgccgagcagucacccuccccagccacucuaccagaaaacuacaaaccagaagccagaccuggcucgaaucaagggaauacacaaaacacuuaaucagggucgaaaacuggauauuccguaacccaggguucgcccucgcggcagccgccauagcauggcuacugggcucgagcacuagccagaaaguaaucuaccucgucaugauauuacugaucgcaccagccuacucaaucagaugcauaggcguaagcaaccgcgacuucguagaagggaugucagguggaacaugggucgacgucguacucgaacacggcgguugcgucacaguaauggcucaggacaagcccacgguagacauagaacuuguaacaacaaccguaagcaacauggccgaaguacgcuccuacugcuacgaagccucaaucucagacauggcauccgacuccagguguccaacgcaaggggaagcguaccuagacaaacaauccgacacacaauacgucugcaaaagaacccuggucgaccgaggcuggggcaacggaugcgggcuauuuggcaaaggcucccuaguaaccugugccaaguucgcaugcuccaagaaaaugaccggcaaauccauacaacccgaaaacuuagaauacagaauaaugcuaucuguucacggaucccaacacagcgggaugauagucaaugacacaggacacgaaacagacgagaacagggccaaaguagaaauaacccccaacagcccacgcgcagaagcuacacugggcggauucggaucucuaggccuagacugcgaaccacgcaccggccuagacuucucagaccucuacuacuugaccaugaauaacaaacacugguuaguccacaaagaaugguuccacgacauaccacuccccuggcacgccggcgcagacacaggcaccccacacuggaacaacaaagaagcccucgucgaguucaaagacgcacacgcgaaacggcagaccgucguaguccucggaagccaagaaggagcgguccacacagcccuagcaggcgcacuagaagcagaaauggacggcgcgaaagggcgacuguccucagggcaccucaaaugucggcucaaaauggacaaacuacgccuuaaaggcguaucguacucacuaugcaccgcggccuucacauucaccaaaauccccgccgaaacacuacauggaaccguaaccgucgaaguacaauacgcaggcaccgaugggcccugcaaagucccugcacaaauggcagucgacaugcaaacacucaccccagucggccgacuaaucacagcuaaccccgugauaacggaguccacagaaaacucgaaaaugaugcucgaacuagacccgcccuucggcgacagcuacauaguuaucggagucggugaaaagaaaauaacccaccacuggcaccgaagcggaagcacccucggaaaagccuucuccaccacccucaaaggcgcccaaagacuagcagccuuaggcgacaccgcgugggacuucggaucuauaggcggaguauucaacuccauaggacgcgcaguccaccaaguauucgggggagcauucagaacacucuucggcgguaugagcuggaucacacaaggccucaugggagcacuccuacucuggaugggcgucaacgcaagggacagauccaucgcccucgcguuucuagcgaccgggggagugcucguauuccucgccacgaacguccacgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10943 - RNA, 2296 nt, Artificial Sequence
  ZIKV (strain MR 766) prME-short variant mRNA Design 3 opt
gggagaaagcuuaccaugggaaaacgcagcgccggauccaucauguggcuagcaucgcucgcaguaguaaucgcgugcgccggugcaaucacacgacgcggcagcgcauacuauauguaccucgaccgaagugaugccgggaaggcgaucucauuugcaaccacgcuaggcguaaauaaaugccacguccagaucauggaccucggccacaugugcgacgccaccaugagcuacgaaugcccgaugcuggacgaaggcguggaacccgaugacgucgacugcuggugcaacacaacaagcaccuggguugucuacggcacgugccaccacaagaaaggcgaagcaagaaggucacgacgagcaguaacgcuaccaagccacagcacacgcaaacuacaaaccagaucacaaacauggcucgagagccgcgaauacaccaaacaccuuauaaaaguagaaaacuggauauucagaaacccgggauucgcccuaguagcaguagcaauagcauggcuacugggcucguccacgagucaaaaaguaauauaccuaguaaugauacuacugauagcacccgccuacucaauccggugcaucggaguauccaacagggacuucguagaagggaugucaggcgggacauggguagacgucguccuagagcacggcggaugcgucacgguaauggcccaagacaaacccacaguagauaucgagcuaguaaccacgaccguaagcaacauggccgaagucagaucguacugcuacgaagccagcaucagcgacauggccuccgacagccgcugcccaacccaaggggaagccuaccuagacaaacaauccgacacacaauacguaugcaaaaggacccuaguagauagaggguggggaaacggauguggucucuucggcaaaggcucccucguaacaugcgccaaauucacaugcagcaaaaagaugacaggcaagucaauacagccagaaaaccucgaguacagaaucaugcucucaguccacgguucacaacacagcggaaugaucggcuacgaaacggaugaagacagagcaaaaguggaaguaacaccuaacagcccacgcgcagaagcgacacuaggaggauucgggagucuaggauuggacugcgaaccaagaacaggccuagacuucagcgaccucuacuaccucacaaugaacaacaaacacuggcuaguccacaaggaaugguuccacgacauaccacuaccauggcacgcgggcgccgacaccggaacaccgcacuggaacaacaaagaagcccucgucgaguucaaagacgcgcacgcaaaacgacaaacgguaguaguccugggcucacaggaaggcgcaguacacacagcgcuagccggagcccuagaggcagaaauggacggcgcaaaaggccgccuguucagcggacaccuaaaaugcagacucaaaauggacaaacuacgccuaaaaggcgugucauacagccucugcacggccgccuuuacguucacaaaagugccagcagaaacacugcacggcacaguuacaguagaaguacaguaugccggaaccgacggcccaugcaaaaucccugugcagauggccguggacaugcaaacacugacaccgguaggacgacuaauaaccgcaaauccagugauaacggaaucaacagaaaacuccaaaaugaugcuggaacucgacccaccauucggcgacagcuacaucgugauaggcguaggagacaagaaaauaacacaccacuggcaccggaguggaagcacgcugggaaaagcauucagcacaacgcucaaaggcgcccagagacucgcggcacucggcgacaccgcaugggacuucggcucaaucggcggggucuuuaacagcaucggacgcgcagugcaccaagucuucggaggcgcguucagaacccucuucggaggcauguccuggauaacccaaggccucaugggcgcacugcuacuauggaugggggucaacgcgagagacagaagcauagccuuagccuuccuggccaccggaggaguacugguauuccuagcaacaaacgugcacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10944 - RNA, 2308 nt, Artificial Sequence
  ZIKV (strain NatalRGN) prME-short variant mRNA Design 3 opt
gggagaaagcuuaccaugggaaaacggagcgcaggcuccauaauguggcuagcaagccuagccgucgugaucgcgugugcaggcgccgucacccggagaggcucggcguacuacauguaccucgaccgaaacgacgcaggagaggcaaucucauuccccacaacacucggaaugaacaaauguuacauccaaauaauggaccuaggccacaugugcgacgcaacaaugagcuacgagugcccaaugcucgacgagggaguagaaccagacgacgucgauugcuggugcaacacaaccagcaccugggucgucuacggaaccugccaccacaagaaaggcgaagcacgccgaagcaggcgcgcagucacucuaccgagucauagcacgcgcaaacuccaaacacgcagccaaaccuggcucgagagcagagaauacacaaagcaccucauccggguagagaacuggaucuucaggaacccaggguucgcccuagccgcagcagcaauagcauggcuccuuggaagcagcaccucacagaaaguaauauaccuaguaaugauucuccucaucgccccagcguacagcauaagaugcaucggagucuccaauagagacuucguagaaggcaugucaggaggcacauggguagacguaguccuagaacacggcggaugcgugaccguaauggcacaagacaaaccaacgguggauauagagcuggucacaaccacaguaagcaacauggcggaaguccggagcuacugcuacgaggcaucaaucagcgacauggcaagcgacagucgaugccccacccaaggcgaagccuaccucgacaaacaaagcgacacgcaauacguaugcaaacgcacacucgucgacaggggguggggaaacggcugcggacucuucggcaaaggcucacucguuaccugcgcaaaauucgcgugcuccaagaaaaugaccggcaaguccauccaaccugaaaaccuggaauaccgaaucaugcuaucgguccacggcagccaacacagcggaaugauagugaacgauacaggucacgaaacagacgagaacagagcaaaaguagaaauaacuccaaacucaccgcgagcagaagccacccugggcggcuucggaagccuaggccucgacugcgaaccccgcaccgggcuagacuuuagcgauuuguacuaccucaccaugaacaacaaacacuggcucguccacaaagaaugguuccacgacauaccccucccauggcacgcgggcgcagacaccggaaccccacacuggaacaacaaagaagccuuaguagaguucaaagacgcacacgcaaagcgacaaaccguagucgugcucggcucccaagaaggagccguacacaccgcacucgccggggcacuggaagcagaaauggacggcgcaaaaggaagacucucaucaggacaccuuaaaugccgacucaaaauggacaaacuaagauuaaagggagucagcuacagucucugcacggcggccuuuaccuucacaaaaauccccgccgaaacacuacacggaacagucaccguggaaguacaauacgcgggaacagauggaccaugcaaagugccagcccaaauggcagucgauaugcaaacccuaacccccguaggacgauugauaacagccaacccagugauaacagaaagcaccgaaaacagcaaaaugaugcuagaacuagaucccccauucggagacagcuacauagucaucgggguaggagaaaagaaaauaacccaccacuggcaccgaagcggcagcacacugggcaaagccuuuucuacgacgcucaaaggagcacaacgacucgcagcucucggagacacagccugggacuucggcaguauaggaggcguauucaacucgauagggagagcaguccaccaaguauucggaggagcauucagaacacuguucggaggcaugagcuggauaacacaaggacuuaugggcgcacuccuacuguggaugggagucaacgcuagagacagaucaauagcccuagccuucuuggccaccggcggaguacucguauuccuugcaacaaacgugcacgcgugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10945 - RNA, 2011 nt, Artificial Sequence
  ZIKV (strain ZikaSPH2015) ME variant mRNA Design 3 opt
gggagaaagcuuaccaugacauccgugggaauagucggacuauuacucaccaccgcaauggccgcagucacccucccaagucacucuacccgcaaacuccaaacccgaucgcagaccuggcucgaaagccgcgaauacacaaaacaccucauccgagucgaaaacuggaucuuccgaaacccaggauucgcccucgccgccgccgcaaucgccuggcuccucgggagcucuacaucacaaaaagucauauaccucguaaugauacuacucauagcccccgccuauuccauccgcuguauaggaguaucaaaccgagacuucguagaaggcaugagcggcggcaccuggguagacaucguacucgaacacggaggcugcguaaccgucauggcacaagacaaacccaccguagacauagaacucgucacaacaaccguaucaaacauggcggaaguccgcuccuacugcuacgaagccucaaucagcgacauggccuccgacucacgcugcccaacacagggcgaggccuaccuagacaaacaaagcgacacccaauacguaugcaaacgcacacucgucgaccgaggcuggggaaacggcugcggccucuucggaaaaggaagccucguaaccugcgccaaauucgccugcuccaagaaaaugacuggaaaauccauacaaccggaaaaccucgaauacagaaucaugcucagcguccacggcucacaacacagcggcaugaucgugaacgacaccggacacgaaaccgacgaaaaccgcgcaaaaguagaaauaacuccaaacucaccacgcgcugaggccacacuaggcggcuucggcucccuagggcucgacugcgaaccaagaaccggucucgacuucucagaccucuacuaccucacaaugaacaacaaacacuggcuuguccacaaagaaugguuccacgacauaccccuccccuggcacgccggcgccgacacaggcacaccccauuggaacaacaaagaagcccucguggaguucaaagacgcgcacgcaaaacggcaaaccguaguagugcuagggucccaagaaggagccguccacacggcccucgcuggagcccucgaagcagaaauggacggcgcuaaaggccgacuguccucaggacaccucaaaugccgccucaaaauggacaaacuacgccucaaagguguuuccuacucacuaugcaccgccgccuucacguucaccaaaaucccagccgaaacccuccacggaacagucaccgucgaagugcaauacgccggcaccgacggccccugcaaagucccagcccaaauggcaguggacaugcaaacccuaaccccagucggccgccuaauuaccgccaaccccgucaucaccgaauccacagaaaacagcaaaaugaugcucgaacucgacccacccuucggcgacucguacaucgugauaggcgucggagaaaagaaaaucacacaccacuggcaccgcagcggcucaacaauaggcaaagcguucgaagccaccguccgcggcgccaaacgcauggccgugcucggcgacacagccugggacuucggauccgucgguggugcccuaaauagcuugggcaagggaauccaccaaaucuucggagccgccuucaaaagccuuuucggagggauguccugguucucccagauccucauaggaacccuacuaauguggcuaggccuaaacacgaagaacggcucaauaagccucaugugccucgcacuaggcggaguacuaaucuuccugucgacugccguauccgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10946 - RNA, 2011 nt, Artificial Sequence
  ZIKV (isolate Z1106033) ME variant mRNA Design 3 opt
gggagaaagcuuaccaugaccagcgucggaauagucggccuccuccucacgacagcgauggcagccgugacacuccccucccacucgacaagaaaacuacaaacacgcucccaaacguggcucgaauccagagaguacacuaaacaccugauccgugucgaaaacuggauauuccgcaacccaggcuucgcccuggcagccgccgcaaucgccuggcuacucggcagcagcaccucacaaaaagucaucuaucuaguaaugauacuccugaucgcgccagcuuacuccauccgcugcauaggaguauccaacagagacuucgucgaaggcaugagcggaggcacaugggucgacgucguccuagaacacggaggaugcgucaccguaauggcacaagauaaacccacggucgacaucgagcuaguuaccacaacagucagcaacauggccgaaguccgcaguuacugcuacgaagccagcauaagcgacauggccucagacagcagaugcccaacccaaggcgaagccuaccucgacaaacagucagacacgcaauacguaugcaaaagaacccucguagaucgaggcuggggcaacggauguggacucuucgggaaaggcagccucguaaccugcgccaaauucgcgugcaguaagaaaaugacaggcaaauccauccaaccagaaaaccucgaauaccguauuaugcucuccguccacggcagccagcacuccggcaugaucguaaacgacaccggacacgagaccgacgaaaaccgagccaaagucgaaaucacccccaacucaccccgcgcagaagccacacucggcggcuucggcucccucggacuggacugcgaaccaaggacaggccuagacuucucagaccuauacuaccucacaaugaacaacaaacacuggcucgugcacaaagaaugguuccacgacaucccccuccccuggcacgccggagcagacaccggaacaccccacuggaacaacaaagaggcccuuguagaguucaaagaugcacacgccaagcgccaaaccguaguuguacugggaagccaagaaggcgcaguacacaccgcacuagcaggagcacuagaagccgaaauggacggcgccaaaggccgccuauccagcggccaccuaaaaugccgccucaaaauggacaagcucaggcugaaaggcgucagcuacucccucugcaccgcagcauucaccuucaccaaaauaccugcagaaacccuccacggcaccgucaccgucgaaguacaauacgcaggcacggacggcccaugcaaaguacccgcccaaauggccguggacaugcaaacccucacaccaguaggccgacucaucacagccaauccaguaaucacggaaagcacagaaaacaguaaaaugaugcuagaacucgacccacccuucggagacucuuacaucgucauaggaguaggcgaaaagaaaaucacccaccacuggcaucgcuccggcucaaccaucggcaaagcauucgaagccaccguacgcggcgccaaacguauggcuguccuaggagacaccgcaugggacuucggaucggucggcggcgcccucaacagccuaggaaaaggcauccaccaaaucuuuggagcggcguucaaaucccucuucggaggaaugucgugguucucccaaauacuaaucgguacgcuacuaauguggcucggccucaacgccaaaaacggaucaauuagccucaugugccuagcacuaggcggaguccuaaucuuccuaagcacagcgguaagcgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10947 - RNA, 1999 nt, Artificial Sequence
  ZIKV (strain MR 766) ME variant mRNA Design 3 opt
gggagaaagcuuaccaugaccuccaucggaauaauuggccuacuacucacaaccgcaauggcggccguaacccuucccucacacuccacucguaaacugcaaacccgcucccagacauggcucgaaucgagagaauacacaaaacaccuaaucaaagucgaaaacuggaucuuccgcaaccccggauucgcccuagucgccgucgcaaucgcauggcuccucggcuccucaaccagccaaaaaguuaucuaccucguaaugauccuccucaucgcacccgcauacucaauacgcugcaucggcgucucuaaccgcgacuuuguagaaggaaugucaggcggcaccugggucgacgucguacucgaacacgggggaugcgucaccgucauggcccaagacaaaccuacagucgacaucgagcuagucacgaccacagucucaaacauggcagagguaagaagcuacugcuacgaagccuccaucuccgauauggccuccgacucccgaugccccacacagggcgaagcauaccuagacaaacaauccgacacccaauacgucugcaaacgcacacucguagaccguggcugggggaacggcugcggacuauucggaaagggcucccucgucacaugcgcgaaauuuaccugcuccaagaaaaugaccggaaaaagcauacagcccgaaaaccucgaauaccgcaucaugcucuccgugcacggcagucaacacucaggcaugauaggcuacgaaacagaugaagaccgcgcaaaggucgaagucaccccaaacucccccagagccgaagccacccucgggggcuucggcagccucggacuagacugcgaaccuagaaccggccuagacuucagcgaccucuacuaccuaacgaugaacaacaaacacuggcuuguacauaaagaaugguuccacgacaucccccugcccuggcacgccggagccgacacaggaacaccgcacuggaacaacaaagaagcacucguugaguucaaagacgcccacgcaaaacgccaaacagucgucguacuaggaagccaagaaggcgccguccacaccgcacuagcaggagcauuagaagccgaaauggacggcgcaaaaggccgccucuucuccggccaccucaaaugccgacuaaaaauggauaaacuccgccucaaaggcgucagcuacucacucugcaccgccgccuucacauucaccaaaguccccgccgaaacacuacacggcaccguaacugucgagguacaauacgccggaacggacggcccuugcaagauacccguacaaauggcaguggacaugcaaacacucacccccgucggcagacuaauaacagccaacccgguaauaaccgaaagcaccgagaacucuaaaaugaugcuagaacucgacccacccuucggcgacagcuacaucgucaucggcgucggcgacaagaagaucacacaccacuggcacagaucagguuccacaaucggcaaggcauucgaagccacgguccgcggcgcaaaacgaauggccguccuaggcgauaccgccugggacuucggcuccgucggaggagucuucaacucccucggaaaaggaauccaccaaaucuuuggagccgccuucaaaucgcuauucggcggcaugagcugguucagccagauccuaauagguacacugcucguauggcucggcuuaaauaccaaaaacggaagcaucucccuaacgugccucgcccucggcggcgucaugaucuuccucuccacagccgugagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10948 - RNA, 2011 nt, Artificial Sequence
  ZIKV (strain NatalRGN) ME variant mRNA Design 3 opt
gggagaaagcuuaccaugacaagcguaggcauagucgggcuccuacuuacaacagccauggcagccguaacauuaccaucacacuccacccgcaaacuacagaccagaucccaaaccuggcucgaaagccgcgaauacacaaaacaccucauacgcgucgaaaacuggaucuucagaaaccccggguuugcccuagcagccgcagcaauagccuggcugcugggaagcuccacaucacaaaaggucaucuaccuaguaaugauccugcucauagccccagccuacuccauccgcugcauaggcgucagcaaccgcgacuucguagaagggaugucaggcgguacauggguagacgucguacucgaacacggaggaugcgucaccguaauggcgcaggacaaaccaacaguagacaucgaacucgucacaaccaccgucucgaacauggccgaagugcgaagcuacugcuaugaagcauccaucucagacauggcguccgacagccgaugccccacccaaggagaggcauaucucgacaaacaaagcgacacccaauaugugugcaaacgcacccucguggaccgcggauggggaaacggaugcggccuguucggaaaaggcucacucguaacaugcgcaaaauucgcaugcagcaagaaaaugaccggaaaaagcauacagccugaaaaccuagaauacagaauaaugcugagcguccacggcucacaacacuccggcaugauaguaaacgacacaggccacgaaaccgacgaaaacagagccaaaguagaaaucacaccaaauuccccacgagcagaagccacacucggcggcuucggcagccuaggccuagacugcgaaccacggacaggacuagacuucagcgaccucuacuaccucacaaugaacaacaaacacuggcugguccacaaagaaugguuccacgauauaccccuccccuggcacgccggagcagacaccggcaccccacacuggaacaacaaagaagcacuggucgaguucaaagacgcucacgcgaaacgccagacagucgucguacugggcagccaagaaggcgccguccacaccgcucucgccggcgcacuagaagcggaaauggacggggcaaaaggccggcuaucaagcggccaccugaaaugccgacucaaaauggacaaacuacgacugaagggcgucagcuacagucuaugcacagccgcauucaccuucacaaaaauccccgcagaaacccuacacggcacagucaccgucgaagugcaauacgccggcacagacggacccugcaaaguccccgcucagauggccgucgacaugcaaacauuaacccccgucggacgacuaauaaccgcaaacccaguaaucaccgaauccacagagaacuccaaaaugaugcucgaacucgaucccccauucggcgacagcuacauaguaaucggcguaggagaaaagaaaauaacgcaccacuggcaccgaagcggcuccaccauaggcaaagcauucgaagcgaccguccgcggagccaaacgcauggcagucuuaggcgacaccgcaugggacuucggcuccgucggcggcgcccuaaacagccucggaaaaggaauccaccaaaucuucggcgccgcauucaaaagccuauucgggggcaugucaugguucucccaaauccugauaggaacccuacucauguggcuagggcugaacaccaaaaacggcagcauaagccuaaugugccuagcacuaggcggaguccucauauuucucucaacagccgucucggccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10949 - RNA, 2038 nt, Artificial Sequence
  ZIKV (strain ZikaSPH2015) ME variant mRNA Design 3 opt
gggagaaagcuuaccauggccauaucaggcgucccuguccucggcuucuucaucaucgccguacuaauguccgcccaagagucaugggccgcagugacccucccaagccacagcacgcgcaaacuacaaacccgcagccagaccuggcucgaaagccgagaauacaccaaacaccuaauaagagucgagaacuggaucuuccgcaaccccggauucgcgcucgcggccgccgccaucgcauggcuccuaggcagcuccaccucacaaaaagucauauaccucgugaugauccuccuuaucgcccccgccuacuccauccgaugcaucggagucagcaaccgagacuucgucgaaggaaugucaggcggcacaugggucgacauaguccucgaacacggcggaugcgucaccguaauggcccaagacaaacccacagucgacaucgagcuagucacaaccacaguaucaaacauggcagaaguaagaagcuacugcuacgaagccuccaucucagacauggccucggacucacgaugccccacgcagggagaagccuaccuggacaaacagucugacacacaauacgucugcaaaagaacccucguagaccgcggauggggcaacggcugcggacuauucggaaagggcucccuaguaaccugcgcaaaauucgcaugcucgaagaaaaugaccggcaaaucaauucaacccgagaacuuagaauaccgcauaaugcucucaguacacggcucacaacauagcgggaugaucguuaacgacaccggccacgaaacagacgaaaaccgagcgaaagucgaaauaacaccaaacagcccacgcgcggaagccacccugggcggcuucgggucccucggcuuagacugcgaaccgcgaacaggacuagacuuuagugaccucuacuaccucaccaugaacaacaaacacugguuaguacauaaagaaugguuccacgacaucccacugcccuggcacgccggcgccgacaccggcacaccccacuggaacaauaaagaagcccucguagaguucaaagacgcccacgcgaaacgacaaacagucgucguacuaggcagccaagaaggcgcuguccacaccgcucucgccggagcacucgaagccgaaauggauggagcgaaaggacgacuaagcuccggccaccucaagugccgacucaaaauggacaagcuccgccugaaaggcgucaguuacucccuuugcacugcagcauuuaccuuuacgaaaauacccgccgaaacucuacacggaaccgucacaguagaaguccaauacgccggcacagacggaccaugcaaggucccagcccaaauggccgucgacaugcaaacacuuaccccaguaggaagacuaauaacagccaaucccguaaucacagaaucuaccgagaacucaaaaaugaugcucgagcucgaucccccauuuggcgacagcuacaucgucauaggggucggcgaaaagaaaaucacacaccacuggcaccgcagcggcagcacaauaggcaaagcauucgaagccacagucagaggcgcaaaacguauggcgguacugggcgacacagccugggacuucggaaguguaggcggagcacuaaacucguuaggcaaaggcauacaccaaauauucggagcagccuucaaaagccuguucggcggaaugucaugguucucgcaaauccuaaucggcacucuccucaugugguuaggccucaacaccaaaaacgggagcaucagccuaaugugccucgcacucggaggagugcucaucuuccuaagcacggcagucuccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10950 - RNA, 2038 nt, Artificial Sequence
  ZIKV (isolate Z1106033) ME variant mRNA Design 3 opt
gggagaaagcuuaccauggccaucagcggcguccccguacucggauucuucaucaucgccguacuaauguccgcccaagaaagcugggcagccgugaccuuaccaucacacucaacuagaaaacuccaaacacgcucccaaaccuggcucgaaucuagagaguacaccaaacaccucauccgaguagaaaacuggaucuuccgaaacccaggauucgcacuugccgcagccgcgaucgcauggcugcucggaagcucuaccucacaaaaaguaauauaccuagucaugauucuccuuaucgcccccgcauacagcauacgcugcaucggagucuccaacagagacuucgucgaaggcaugagcggcggcacauggguagacguaguccucgaacacggaggaugcgucaccguaauggcccaagacaaacccaccguagacauagaacuggucacaacaaccgucucaaacauggccgagguaaggagcuacugcuacgaagccuccaucuccgacauggcaagcgacagucgcugcccaacccaaggagaagccuaccuagacaagcaaagugacacccaauacguaugcaaacgaacccucgucgaccgaggauggggaaacgggugcggccuauucggaaaaggaagccucgucacgugcgcaaaauucgcaugcagcaagaaaaugacaggcaaaagcauccaacccgaaaaccucgaguacagaauaaugcuaagcgugcacggcucacaacacuccggcaugaucguaaacgacacaggacacgaaaccgacgagaaccgagccaaagucgaaaucacccccaacucaccacgcgccgaagcaacccucggcggauuugguucccucggacuagacugcgaaccaagaaccggacucgacuucuccgacuuauacuaccuaaccaugaacaacaaacacuggcuaguacauaaagaaugguuccacgacaucccacuacccuggcacgcgggcgcggacaccggcaccccacacuggaacaacaaagaagcacucguagaauuuaaagacgcacacgccaaacgccaaacagugguagugcuaggaucccaggaaggagccguccacaccgcacucgcaggggcccuugaagccgaaauggacggagcgaaaggccgccuuucgagcggacaccucaagugccgccuaaagauggacaaacuccgacucaagggaguaagcuacucccucugcacagcagcauucacauucacaaaaauacccgccgagacacuucacggcaccgucaccgucgaaguccaguaugccggaaccgacggacccugcaaaguaccagcucaaauggccguagacaugcaaacccuaacgcccgucggacgacuaauaacagcgaacccggucaucaccgaaucaaccgaaaacagcaaaaugaugcucgaacuagaucccccauucggagacagcuacauaguaaucggcguaggagaaaagaaaaucacgcaccacuggcaccgcucaggaucaaccauaggaaaagcguucgaagcaaccgugcgcggcgcuaaacgcauggcaguccucggcgacaccgccugggacuuuggaucagucggaggagcccucaacagccucggcaaaggcauacaccaaaucuucggagcagccuuuaaaucccucuucggaggcaugucgugguucagccaaauacuaaucgggacccuacuaauguggcuaggacucaacgccaaaaacggcagcauaucccucaugugccuagcccucggcggaguccucauauuucuaucaacagccgucucagcuugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10951 - RNA, 2026 nt, Artificial Sequence
  ZIKV (strain MR 766) ME variant mRNA Design 3 opt
gggagaaagcuuaccauggcgauauccggagucccaguccucggcuucuucaucaucgcaguccugaugucagcgcaagaaagcugggcagcggucacacuacccagccacuccacacgcaaacuccaaacacgcagccagacauggcuagaaucccgcgaauacacaaaacaccucaucaagguagaaaacuggaucuuccgaaaccccggauucgcgcucgucgcuguagcaaucgcauggcuacucggcagcucgacaucgcaaaaagucaucuaccuagucaugauccuacucaucgcacccgccuacuccauaagaugcaucggcgucuccaaccgagacuucguagaaggaaugucaggcggcaccugggucgacgucguccuagagcacggaggcugcguaaccgucauggcacaggacaaaccaacagucgacauagaacucguaacaaccaccguaucaaacauggccgaaguccguucauacuguuacgaagccucaauaagugacauggccucagacagccgaugccccacccagggggaggcauaccuggacaagcaaucagacacccaauacgucugcaaaagaacgcucguagaccgcggcugggguaacggcugcgggcuauucggcaaaggcucccucgucacgugcgccaaauucacgugcagcaagaaaaugaccggaaaaagcauccaaccugaaaaccucgaauaccgaauaaugcuguccguccacggcagccaacacagcggcaugaucggcuacgaaaccgacgaagaccgcgcaaaagucgaagucacacccaacucaccacgcgcggaagccacacugggaggauucggaagccuaggacuagacugcgaaccacgaacaggacucgacuucagcgaccuuuacuaccucaccaugaacaacaaacacugguuaguccacaaagaaugguuccacgacaucccccuccccuggcacgccggagccgacacaggaacgccccacuggaacaacaaagaagcccucgucgaguucaaagacgcgcacgcaaaaaggcaaaccgucgucguucuaggaucacaagaaggcgcgguacacaccgcgcuagccggcgcccuagaagccgaaauggacggugccaaaggucgccucuucucaggacaccucaaaugccggcugaaaauggacaaacuccgccuaaaaggcguauccuacagccucugcaccgcagccuucaccuucacaaaagucccugccgaaacccugcacggcaccgucaccgucgaaguccaauacgccggaacggauggccccuguaaaauccccguacaaauggccguagacaugcaaacccucacgcccguaggccgacucaucaccgccaacccagucauaacagaauccaccgaaaauagcaagaugaugcuagaacucgaucccccauucggagacucauacauagucaucggagucggcgacaaaaagauaacacaccacuggcaccgcucaggcucaaccaucggcaaagccuucgaagccaccguccgcggcgcaaaaagaauggcaguccucggagacaccgcaugggacuucggcuccguaggaggcguauucaauagccuaggcaagggcauucaccaaauauucggggcagccuucaagagcuuauucggcgggaugucaugguucucccaaauacucaucggaacacuccuaguguggcucggccucaacacaaagaacggcucaaucagccuuaccugccucgcacucggaggcgugaugauauuccuauccacagccguauccgccugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 10952 - RNA, 2038 nt, Artificial Sequence
  ZIKV (strain NatalRGN) ME variant mRNA Design 3 opt
gggagaaagcuuaccauggcaauauccggcgugcccguacucggauucuucaucaucgccguccucaugucagcgcaagaauccugggcagccguaacacuccccucccacagcacccgcaaacuacaaacaagaagccaaaccuggcuagaaucacgagaauacaccaagcaccuuauaagagucgaaaacuggauauuccgaaacccaggauucgcacuggcggccgcagcaauagcauggcuccuaggcucgaguacaagccaaaaaguaaucuaccucguaaugauccuacuaaucgcacccgcguacucaaucagaugcaucggcgucagcaacagagacuucguagaaggaauguccggagggacuugggucgacguaguacuagaacacggcggcugcgucacaguaauggcacaagacaaaccaaccgucgacauagagcuagugaccacaaccgucagcaacauggcggaaguacgcagcuacugcuacgaagcaagcauaucggacauggcaagcgacagccgcugcccaacacagggcgaagcauaccuagacaaacaauccgacacccaauacguuugcaagcgaacacucgucgaccgcggcuggggcaacggcugcggccuauucggcaaaggcucccuaguaacaugcgcaaaauucgcaugcucuaagaagaugacaggcaagagcauacaaccagaaaaccucgaauacaggaucaugcuaucgguccacgguucacaacauucaggcaugaucgucaaugacacgggacacgaaaccgacgaaaaccgcgccaagguggaaauaacgcccaacaguccccgcgccgaggcaacccugggcgguuucggcagccucggccucgacugcgaaccaagaaccggacucgacuucagcgaccuauacuaccuaacuaugaacaacaagcacuggcuuguccacaaagagugguuccacgacauaccccuccccuggcacgcaggagcagacaccggaaccccacacuggaacaacaaagaagcacucguagaguucaaagacgcccacgcgaaaagacaaacagucgugguacuggggagccaagaaggugccguccacacagcccuagccggagcacucgaagcagaaauggacggcgcaaaagggcgccucucaucaggccaccuaaagugccgacuaaaaauggacaaacuccgccuaaaaggcguaucuuacucccuaugcaccgccgcauucaccuuuacaaagauaccggccgaaacccuccacggcaccguaacaguagaaguccaauacgccggcaccgacggccccugcaaaguccccgcccaaauggcaguagacaugcaaacacuaacacccgucggccgacucauaaccgccaaccccgucauaacagaaaguacugaaaacuccaaaaugaugcucgaacucgacccacccuucggagacagcuacauagucauaggcgucggcgagaaaaagauaacccaccacuggcaccgcuccggcuccacaauaggcaaggccuucgaagccaccguaagaggcgcaaaacgcauggcaguccugggagacacagcaugggacuucggcuccguuggaggggcacuaaacucacuagggaaaggcauacaucaaauuuucggcgcagccuucaaaagccuauucggcggaaugagcugguucagccaaauacuaaucggcacacuacuuauguggcucggccucaacacgaaaaacggaagcaucucccuaaugugccuagcacucggcggcgugcuaauauuccuaagcacagcagucagcgcaugaggacuaguuauaagacugacuagcccgaugggccucccaacgggcccuccuccccuccuugcaccgagauuaauagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu
